US008846034B2

(12) United States Patent
Jiang et al.

(10) Patent No.: US 8,846,034 B2
(45) Date of Patent: Sep. 30, 2014

(54) COMPANION DIAGNOSTIC FOR ANTI-HYALURONAN AGENT THERAPY AND METHODS OF USE THEREOF

(71) Applicants: Ping Jiang, San Diego, CA (US); H. Michael Shepard, San Diego, CA (US); Lei Huang, San Diego, CA (US)

(72) Inventors: Ping Jiang, San Diego, CA (US); H. Michael Shepard, San Diego, CA (US); Lei Huang, San Diego, CA (US)

(73) Assignee: Halozyme, Inc., San Diego, CA (US)

( * ) Notice: Subject to any disclaimer, the term of this patent is extended or adjusted under 35 U.S.C. 154(b) by 4 days.

(21) Appl. No.: 13/694,071

(22) Filed: Oct. 24, 2012

(65) Prior Publication Data

US 2013/0202583 A1 Aug. 8, 2013

Related U.S. Application Data

(60) Provisional application No. 61/628,187, filed on Oct. 24, 2011, provisional application No. 61/559,011, filed on Nov. 11, 2011, provisional application No. 61/630,765, filed on Dec. 16, 2011, provisional application No. 61/714,700, filed on Oct. 16, 2012.

(51) Int. Cl.
*C07K 14/81* (2006.01)
*G01N 33/574* (2006.01)
*A61K 38/47* (2006.01)
*G01N 33/566* (2006.01)
*G01N 33/68* (2006.01)

(52) U.S. Cl.
CPC ........ *G01N 33/6893* (2013.01); *G01N 2800/52* (2013.01); *C07K 2319/00* (2013.01); *G01N 2333/705* (2013.01); *G01N 33/574* (2013.01); *A61K 38/47* (2013.01); *G01N 33/566* (2013.01)
USPC .................................................... 424/94.62

(58) Field of Classification Search
CPC ...................................................... C07K 14/81
USPC ..................................................... 424/94.62
See application file for complete search history.

(56) References Cited

U.S. PATENT DOCUMENTS

| 2,488,564 | A | 11/1949 | Singher et al. ................ 435/201 |
| 2,488,565 | A | 11/1949 | Singher et al. ................ 435/201 |
| 2,676,139 | A | 4/1954 | Tint et al. ..................... 424/201 |
| 2,795,529 | A | 6/1957 | Alburn et al. ................ 424/94.3 |
| 2,806,815 | A | 9/1957 | Orlando ........................ 435/188 |
| 2,808,362 | A | 10/1957 | Thompson et al. ........... 435/201 |
| 4,002,531 | A | 1/1977 | Royer ........................... 435/188 |
| 4,179,337 | A | 12/1979 | Davis et al. ................... 435/181 |
| 4,751,180 | A | 6/1988 | Cousens et al. ................ 435/68 |
| 4,935,233 | A | 6/1990 | Bell et al. ..................... 424/85.5 |
| 4,952,496 | A | 8/1990 | Studier et al. .............. 435/91.41 |
| 5,019,498 | A | 5/1991 | Chichibu et al. ............... 435/7.5 |
| 5,116,964 | A | 5/1992 | Capon et al. .................... 536/27 |
| 5,122,614 | A | 6/1992 | Zalipsky ....................... 548/520 |
| 5,324,844 | A | 6/1994 | Zalipsky ....................... 548/520 |
| 5,446,090 | A | 8/1995 | Harris .......................... 525/54.1 |
| 5,457,035 | A | 10/1995 | Baum et al. ................... 435/69.5 |
| 5,612,460 | A | 3/1997 | Zalipsky .................... 530/391.9 |
| 5,643,575 | A | 7/1997 | Martinez et al. ........... 424/194.1 |
| 5,672,662 | A | 9/1997 | Harris et al. .................. 525/408 |
| 5,731,168 | A | 3/1998 | Carter et al. ................. 435/69.1 |
| 5,747,027 | A | 5/1998 | Stern et al. ................ 424/94.62 |
| 5,766,581 | A | 6/1998 | Bartley et al. ............... 424/85.1 |
| 5,795,569 | A | 8/1998 | Bartley et al. ............... 424/85.1 |
| 5,808,096 | A | 9/1998 | Zalipsky ....................... 548/520 |
| 5,827,721 | A | 10/1998 | Stern et al. ..................... 435/201 |
| 5,900,461 | A | 5/1999 | Harris ......................... 525/54.11 |
| 5,919,455 | A | 7/1999 | Greennnwald et al. ..... 424/178.1 |
| 5,932,462 | A | 8/1999 | Harris et al. .................. 435/188 |
| 5,985,263 | A | 11/1999 | Lee et al. ..................... 424/85.2 |
| 5,986,052 | A | 11/1999 | Goetinck et al. ............. 530/350 |
| 5,990,237 | A | 11/1999 | Bentley et al. ............... 525/54.2 |
| 6,054,569 | A | 4/2000 | Benett et al. |
| 6,103,525 | A | 8/2000 | Stern et al. .................... 435/326 |
| 6,113,906 | A | 9/2000 | Greenwald et al. ........ 424/194.1 |
| 6,193,963 | B1 | 2/2001 | Stern et al. ................... 424/94.6 |
| 6,214,966 | B1 | 4/2001 | Harris .......................... 528/322 |
| 6,258,351 | B1 | 7/2001 | Harris .......................... 424/78.3 |
| 6,271,344 | B1 | 8/2001 | Turley et al. ................. 530/326 |
| 6,340,742 | B1 | 1/2002 | Burg et al. .................... 530/351 |
| 6,413,507 | B1 | 7/2002 | Bentley et al. ................. 424/78 |
| 6,420,339 | B1 | 7/2002 | Gegg et al. ..................... 514/12 |
| 6,437,025 | B1 | 8/2002 | Harris et al. .................. 523/406 |

(Continued)

FOREIGN PATENT DOCUMENTS

CN 101899118 12/2010
EP 0400472 12/1990

(Continued)

OTHER PUBLICATIONS

Letter/Written Disclosure of the Supplemental Information Disclosure Statement for the above-referenced application, mailed Apr. 3, 2014, 2 pages.

Al'Qteishat et al., "Changes in hyaluronan production and metabolism following ischaemic stroke in man," Brain. 129(Pt 8):2158-2176 (2006).

(Continued)

*Primary Examiner* — Karen Cochrane Carlson

(74) *Attorney, Agent, or Firm* — McKenna Long & Aldridge LLP; Stephanie Seidman; Karen G. Potter

(57) ABSTRACT

Methods and diagnostic agents for identification of subjects for cancer treatment with an anti-hyaluronan agent, such as a hyaluronan-degrading enzyme, are provided. Diagnostic agents for the detection and quantification of hyaluronan in a biological sample and monitoring cancer treatment with an anti-hyaluronan agent, for example a hyaluronan-degrading enzyme, are provided. Combinations and kits for use in practicing the methods also are provided.

58 Claims, No Drawings

(56) References Cited

U.S. PATENT DOCUMENTS

| | | | |
|---|---|---|---|
| 6,448,369 B1 | 9/2002 | Bentley et al. | 528/425 |
| 6,461,802 B1 | 10/2002 | Van Thillo et al. | 430/336 |
| 6,495,659 B2 | 12/2002 | Bentley et al. | 528/425 |
| 6,737,505 B2 | 5/2004 | Bentley et al. | 528/425 |
| 6,828,401 B2 | 12/2004 | Nho et al. | 526/333 |
| 6,858,736 B2 | 2/2005 | Nho et al. | 546/290 |
| 7,105,330 B2 | 9/2006 | Stern et al. | 435/200 |
| 7,148,201 B2 | 12/2006 | Stern et al. | 514/44 R |
| 7,153,670 B2 | 12/2006 | Hastings et al. | 435/69.1 |
| 7,219,016 B2 | 5/2007 | Rimm et al. | 702/19 |
| 7,257,268 B2 | 8/2007 | Eichhorn et al. | 382/253 |
| 7,646,905 B2 | 1/2010 | Guittet et al. | 382/133 |
| 7,723,472 B2 | 5/2010 | Szoka et al. | 530/324 |
| 7,767,429 B2 | 8/2010 | Frost et al. | 435/201 |
| 7,781,397 B2 | 8/2010 | Stern et al. | 424/94.62 |
| 7,829,081 B2 | 11/2010 | Bookbinder et al. | 424/94.62 |
| 7,846,431 B2 | 12/2010 | Bookbinder et al. | 424/94.62 |
| 7,871,607 B2 | 1/2011 | Bookbinder et al. | 424/94.62 |
| 8,023,714 B2 | 9/2011 | Soenksen | 382/132 |
| 8,034,630 B2 | 10/2011 | Terashima | 435/69.1 |
| 8,105,586 B2 | 1/2012 | Bookbinder et al. | 424/94.3 |
| 8,187,855 B2 | 5/2012 | Baker et al. | 435/201 |
| 8,202,517 B2 | 6/2012 | Bookbinder et al. | 424/94.62 |
| 8,257,699 B2 | 9/2012 | Bookbinder et al. | 424/94.62 |
| 8,343,487 B2 | 1/2013 | Baker et al. | 424/94.62 |
| 8,431,124 B2 | 4/2013 | Bookbinder et al. | 424/94.62 |
| 8,431,380 B2 | 4/2013 | Bookbinder et al. | 435/201 |
| 8,580,252 B2 | 11/2013 | Bookbinder et al. | 424/85.2 |
| 2001/0021763 A1 | 9/2001 | Harris | 528/75 |
| 2001/0044526 A1 | 11/2001 | Shen | 530/409 |
| 2001/0046481 A1 | 11/2001 | Bentley et al. | 424/78.18 |
| 2002/0052430 A1 | 5/2002 | Harris et al. | 523/406 |
| 2002/0072573 A1 | 6/2002 | Bentley et al. | 525/409 |
| 2002/0156047 A1 | 10/2002 | Zhao | 514/58 |
| 2003/0054991 A1 | 3/2003 | Takashima et al. | 514/13 |
| 2003/0114647 A1 | 6/2003 | Harris et al. | 530/402 |
| 2003/0143596 A1 | 7/2003 | Bentley et al. | 435/6 |
| 2003/0158333 A1 | 8/2003 | Roberts et al. | 530/402 |
| 2003/0170243 A1 | 9/2003 | Stern et al. | 514/44 |
| 2003/0220447 A1 | 11/2003 | Harris | 528/322 |
| 2004/0013637 A1 | 1/2004 | Bentley et al. | 424/78.17 |
| 2004/0235734 A1 | 11/2004 | Bossard | 514/12 |
| 2004/0268425 A1 | 12/2004 | Bookbinder et al. | 800/18 |
| 2005/0114037 A1 | 5/2005 | Desjarlais et al. | 702/19 |
| 2005/0171328 A1 | 8/2005 | Harris | 528/322 |
| 2005/0209416 A1 | 9/2005 | Harris | 525/523 |
| 2005/0260186 A1 | 11/2005 | Bookbinder et al. | 424/94.62 |
| 2006/0024298 A1 | 2/2006 | Lazar et al. | 530/387.1 |
| 2006/0104968 A1 | 5/2006 | Bookbinder et al. | 424/94.62 |
| 2007/0286856 A1 | 12/2007 | Brown et al. | 530/388.26 |
| 2008/0003659 A1 | 1/2008 | Short et al. | 436/501 |
| 2009/0030180 A1 | 1/2009 | Kolodka et al. | 514/2.6 |
| 2009/0123367 A1 | 5/2009 | Bookbinder et al. | 424/1.49 |
| 2009/0181032 A1 | 7/2009 | Bookbinder et al. | 424/141.1 |
| 2009/0186018 A1 | 7/2009 | Abbas et al. | 536/23.2 |
| 2009/0214505 A1 | 8/2009 | Bookbinder et al. | 424/94.1 |
| 2009/0253175 A1 | 10/2009 | Bookbinder et al. | 435/69.1 |
| 2010/0003238 A1 | 1/2010 | Frost et al. | 424/94.62 |
| 2010/0074885 A1 | 3/2010 | Schiff et al. | 424/130.1 |
| 2010/0136549 A1 | 6/2010 | Christiansen et al. | 702/19 |
| 2010/0143457 A1 | 6/2010 | Wei et al. | 424/450 |
| 2011/0066111 A1 | 3/2011 | Teschner et al. | 514/183 |
| 2011/0111435 A1 | 5/2011 | Dobson et al. | 435/6 |
| 2011/0152359 A1 | 6/2011 | Bookbinder et al. | 435/200 |
| 2011/0195512 A1 | 8/2011 | Terashima et al. | 435/69.1 |
| 2012/0020951 A1 | 1/2012 | Shepard et al. | 424/130.1 |
| 2012/0148555 A1 | 6/2012 | Bookbinder et al. | 435/200 |
| 2012/0171153 A1 | 7/2012 | Frost et al. | 424/94.62 |
| 2012/0251620 A1 | 10/2012 | Bookbinder et al. | 424/450 |
| 2012/0294830 A1 | 11/2012 | Bookbinder et al. | 424/85.2 |
| 2013/0058893 A1 | 3/2013 | Bookbinder et al. | 435/200 |
| 2013/0251786 A1 | 9/2013 | Li et al. | 424/94.62 |
| 2013/0302275 A1 | 11/2013 | Wei et al. | 424/94.62 |
| 2013/0302400 A1 | 11/2013 | Maneval et al. | 435/195 |
| 2014/0037613 A1 | 2/2014 | Bookbinder et al. | 424/94.62 |

FOREIGN PATENT DOCUMENTS

| | | |
|---|---|---|
| EP | 0822199 | 9/2004 |
| EP | 1064951 | 8/2007 |
| WO | WO 92/16640 | 10/1992 |
| WO | WO 93/10151 | 5/1993 |
| WO | WO 94/28024 | 12/1994 |
| WO | WO 98/50431 | 11/1998 |
| WO | WO 99/45942 | 9/1999 |
| WO | WO 00/02017 | 1/2000 |
| WO | WO 01/87925 | 4/2001 |
| WO | WO 02/49673 | 6/2002 |
| WO | WO 2005/000360 | 1/2005 |
| WO | WO 2005/063816 | 7/2005 |
| WO | WO 2005/118799 | 12/2005 |
| WO | WO 2007/133725 | 11/2007 |
| WO | WO 2009/111066 | 9/2009 |
| WO | WO 2009/128917 | 10/2009 |
| WO | WO 2013/063155 | 5/2013 |

OTHER PUBLICATIONS

Delpech et al., "Immunoenzymoassay of the hyaluronic acid-hyaluronectin interaction: application to the detection of hyaluronic acid in serum of normal subjects and cancer patients," Anal Biochem 149(2):555-565 (1985).

Derwent English abstract for Chinese patent CN 101899118, published Dec. 1, 2010, entitled: "New fusion protein of hyaluronan binding protein and monomeric Katushka, useful for measuring hyaluronic acid," Derwent World Patents Index, Accession Nbr. 2011A34910, 2 pages.

Jacobetz et al., "Hyaluronan impairs vascular function and drug delivery in a mouse model of pancreatic cancer," Gut. 62(1):112-120 (2013).

Kultti et al., "Therapeutic targeting of hyaluronan in the tumor stroma," Cancers. 4(3):873-903 (2012).

Provenzano et al., "Enzymatic targeting of the stroma ablates physical barriers to treatment of pancreatic ductal adenocarcinoma," Cancer Cell. 21(3):418-429 (2012).

Shuster et al., "Hyaluronidase reduces human breast cancer xenografts in SCID mice," Int. J. Cancer 102:192-197 (2002).

Toole et al., "Hyaluronan-cell interactions in cancer and vascular disease," J Biol Chem. 277(7):4593-4596 (2002) Epub Nov. 20, 2001.

Frost, G., "Halozyme Therapeutics, Inc. Thinking outside the cell," Oct. 2013. Presentation, 46 pages.

Halozyme Therapeutics, J.P. Morgan Annual Healthcare Conference Presentation, Jan. 2013, Presentation, 18 pages.

Jiang et al., "Effects of recombinant human PH2O (rHuPH2O) on interstitial matrices: Creating a favorable environment for the delivery of cytostatic agents," [abstract]. In: Proceedings of the 96th Annual Meeting of the American Association for Cancer Research; Apr. 16-20, 2005; Anaheim, CA.:AACR; 2005. vol. 46, p. 1198, Abstract No. 5075, Apr. 2005. (no poster found).

Jiang et al., "Phase 1 pharmacodynamic activity of multiple-dose PEGylated hyaluronidase PH2O (PEGPH2O) in patients with solid tumors," AACR Annual Meeting Apr. 6-10, 2013, Washington, D.C., Poster 3375 and panels thereof, 11 pages.

Kultti et al., "The role of hyaluronan-CD44 interaction in breast cancer," AACR Annual Meeting Apr. 6-10, 2013, Washington, D.C., Abstract # 511, Retrieved from: <URL:cancerres.aacrjournals.org/cgi/content/meeting_abstract/73/8_MeetingAbstracts/511 [Retrieved from the internet Apr. 5, 2013], 1 page.

Li et al., "Tumor-targeted hyaluronan (HA) imaging with a recombinant HA binding protein: TSG6dHep-Fc,"[online], Retrieved from:<URL:cancerres.aacrjournals.org/cgi/content/meeting_abstract/73/8_MeetingAbstracts/3915AACR Annual Meeting Apr. 6-10, 2013, Washington, D.C., Abstract #3915 [Retrieved from the internet Apr. 5, 2013], 1 page.

Torley, H., "Halozyme Therapeutics, Inc. The next chapter begins: creating value through growth," Presented at the 32nd Annual J.P. Morgan Healthcare Conference Jan. 2014, 26 pages.

News Release, Halozyme Therapeutics, Inc., "Halozyme announces Roche marketing authorization for MabThera SC for patients with

(56) References Cited

OTHER PUBLICATIONS common forms of non-hodgkin lymphoma in European Union," Published Mar. 28, 2014 [online], Retrieved from: <URL:halozyme.com/Investors/News-Releases/News-Release-Details/2014/Halozyme-Announces-Roche-Marketing-Authorization-For-MabThera-SC-For-Patients-With-Common-Forms-Of-Non-Hodgkin-Lymphoma-In-European-Union/default.aspx [retrieved on Mar. 31, 2014] 3 pages.
News Release, "Halozyme begins randomized, controlled clinical trial with PEGPH2O in patients with advanced pancreatic cancer," Published Oct. 5, 2011 [online][Retrieved May 30, 2013]Retrieved from:<URL:halozyme.com/Investors/News-Releases/News-Release-Details/2011/Halozyme-Begins-Randomized-Controlled-Clinical-Trial-with-PEGPH20-in-Patients-with-Advanced-Pancreatic-Cancer1126802/default.aspx, 1 page.
News Release, "Halozyme initiates randomized phase 2 trial of PEGPH2O in pancreatic cancer," Published Apr. 23, 2013 [online][Retrieved May 16, 2013]Retrieved from:<URL:halozyme.com/Investors/News-Releases/News-Release-Details/2013/Halozyme-Initiates-Randomized-Phase-2-Trial-of-PEGPH20-in-Pancreatic-Cancer/default.aspx, 3 pages.
News Release, "Halozyme to present new data on PEGPH2O in pancreatic cancer at American Society of Clinical Oncology Annual Meeting," Published on May 15, 2013 [online][retrieved on May 16, 2013] Retrieved from:<URL:halozyme.com/Investors/News-Releases/News-Release-Details/2013/Halozyme-To-Present-New-Data-On-PEGPH20-In-Pancreatic-Cancer-At-American-Society-of-Clinical-Oncology-Annual-Meeting/default.aspx, 3 pages.
Partial International Search Report, mailed Mar. 14, 2013, in connection with International Patent Application No. PCT/US2012/061743, 3 pages.
International Search Report and Written Opinion, mailed May 24, 2013, in connection with International Patent Application No. PCT/US201/061743, 25 pages.
Response, dated Aug. 26, 2013, to Written Opinion, mailed May 24, 2013, in connection with International Patent Application No. PCT/US201/061743, 30 pages.
International Preliminary Report on Patentability, mailed Feb. 3, 2014, in connection with International Patent Application No. PCT/US201/061743, 17 pages.
Letter/Written Disclosure of the Information Disclosure Statement for the above-referenced application, mailed on Feb. 15, 2013, 2 pages.
Baranova et al., "The inflammation-associated protein TSG-6 cross-links hyaluronan via hyaluronan-induced TSG-6 oligomers," J Biol Chem. 286(29):25675-25686 (2011).
Chang et al., "Fusion protein of the hyaluronan binding domain from human TSG-6 with luciferase for assay of hyaluronan," Biotechnol Lett. 25(13):1037-1040 (2003).
Civalleri et al., "Effects of adjuvant hyaluronidase in tumors refractory to chemotherapy. Review of the literature and pharmacokinetics of cisplatin after regional administration in animals and humans," G Chir 18(4):175-181[article in Italian, summary in the English language] (1997).
ClinicalTrials.gov, "Safety study of PEGPH2O given to patients with advanced solid tumors," ClinicalTrials.gov identifier: NCT00834704; study first received: Jan. 29, 2009; last updated: Sep. 10, 2012. [retrieved on Feb. 15, 2013] Retrieved from the Internet:<URL:clinicaltrials.gov/ct2/show/NCT00834704?term=PEGPH20&rank=1 [3 pages].
ClinicalTrials.gov, "Study of PEGPH2O with initial dexamethasone premedication given intravenously to patients with advanced solid tumors," Clinical Trials.gov identifier: NCT01170897; study first received: Jul 26, 2010; last updated: Sep. 21, 2012. [retrieved on Feb. 14, 2013] Retrieved from the Internet:< URL:clinicaltrials.gov/ct2/show/NCT01170897?term=HALO-102&rank=1 [3 pages].
Hernández Hernández et al., "Clinical utility of hyaluronic acid values in serum and bronchoalveolar lavage fluid as tumor marker for bronchogenic carcinoma," Int J Biol Markers 10(3):149-155 (1995).
Jiang et al., "Effective targeting of the tumor microenvironment for cancer therapy," Anticancer Research 32:1203-1212 (2012).
Nagyeri et al., "TSG-6 protein, a negative regulator of inflammatory arthritis, forms a ternary complex with murine mast cell tryptases and heparin," J Biol Chem. 286(26):23559-23569 (2011).
Park et al., "Anti-tumor therapy mediated by 5-fluorocytosine and a recombinant fusion protein containing TSG-6 hyaluronan binding domain and yeast cytosine deaminase," Mol Pharm. 6(3):801-812 (2009).
Park, J. "Matrix attachment therapy for cancer," Szoka Laboratory, University of California, San Francisco, Publication No. 3311355 (2008) [189 pages]. Dissertation.
Wisniewski et al., "TSG-6 protein binding to glycosaminoglycans: formation of stable complexes with hyaluronan and binding to chondroitin sulfates," J Biol Chem. 280(15):14476-14484 (2005).
Dychter et al., "Targeting hyaluronan in tumor stroma. Interim translational and biomarker evaluations of pegylated hyaluronidase (PEGPH20) in animal models and patients with advanced solid tumors," European Organisation for Research and Treatment of Cancer-National Cancer Institute-American Society of Clinical Oncology (EORTC-NCI-ASCO) Annual Meeting on "Molecular Markers in Cancer", Oct. 27-29, 2011, Brussels, Belgium. European Journal oc Cancer 47(Suppl.4): S30-531, PP60. Abstract, 2 pages.
Frost, G. I., "Halozyme Therapeutics, Inc. Thinking outside the cell," presented at J. P. Morgan Healthcare Conference on Jan. 10, 2013. Presentation. 23 pages.
Huang et al., "Characterization of a new recombinant HA binding protein: TSG6dHep-Fc," Presented at the Joint Meeting of the Society for Glycobiology & American Socitey of Matrix Biology, held on Nov. 11-14, 2012, San Diego, CA. Abstract #76, 1 page.
Huang et al., "Characterization of a new recombinant HA binding protein: TSG6dHep-Fc," Presented at the Joint Meeting of the Society for Glycobiology & American Socitey of Matrix Biology, held on Nov. 11-14, 2012, San Diego, CA. Poster #B10, 1 page.
Jiang et al "PEGPH2O: PEGylated recombinant human hyaluronidase antitumor activity in the 4T1 orthotopic breast carcinoma model," 2009 AACR, Apr. 29, 2009. Abstract, 1 page.
Jiang et al "PEGPH2O: PEGylated recombinant human hyaluronidase antitumor activity in the 4T1 orthotopic breast carcinoma model," 2009 AACR, Apr. 29, 2009. Poster, 1 page.
Jiang et al., "Hyaluronan (HA) accumulation in tumors correlates with response to pegylated rHuPH2O hyaluronidase (PEGPH2O) in human tumors: a biomarker strategy," American Association for Cancer Research (AACR-EORTC) Annual Meeting, San Francisco, CA. Presented Nov. 14, 2011. Poster #B35, 1 page.
Jiang et al., "Hyaluronan (HA) accumulation in tumors correlates with response to pegylated rHuPH2O hyaluronidase (PEGPH2O) in human tumors: a biomarker strategy," American Association for Cancer Research (AACR-EORTC) Annual Meeting, San Francisco, CA. Published on-line Nov. 12, 2011. Abstract #B35, 2 pages.
Maneval et al., "Phase 1 pharmacokinetics (PK) & pharmacodynamics (PD) of PEGylated hyaluronidase PH2O (PEGPH2O) in patients with solid tumors,"AACR Annual Meeting 2012. Available on-line Mar., 2012. [Retrieved from the internet Apr. 17, 2012], Abstract #3796, 1 page.
Ramanathan et al., "Targeting hyaluronan in tumor stroma: Interim translational & biomarker evaluations of pegylated hyaluronidase (PEGPH2O) in animal models & patients with advanced solid tumors," European Organisation for Research and Treatment of Cancer-National Cancer Institute-American Society of Clinical Oncology (EORTC-NCI-ASCO) Annual Meeting on "Molecular Markers in Cancer", Oct. 27-29, 2011, Brussels, Belgium. Poster, 1 page.
Shepard, M., "PEGPH2O-A targeted therapy for cancer treatment," presented at Target Discovery World Congress, South San Francisco, CA., Aug. 4-5, 2009. Oral presentation, 13 pages.
Whatcott et al., "Hyaluronan deposition correlates with poor survival in pancreatic cancer," American Association of Cancer Research Annual Meeting, Orlando, FL., Apr. 5, 2011. Abstract, 1 page.
Halozyme Therapeutics Investor Presentation, "Halozyme Therapeutics, Inc.: Thinking outside the cell," Presented on Oct. 2, 2012 [online][retrieved on Oct. 11, 2012] Retrieved from:<URL:sec.gov/Archives/edgar/data/1159036/000119312512412748/d419091dex991.htm [82 pages].

(56) References Cited

OTHER PUBLICATIONS

Transcript, "Halozyme Therapeutics's CEO Hosts Analyst/Investor Day Conference Call (Transcript)," Published on Oct. 2, 2012 [online] [Retrieved on Oct. 25, 2012] Retrieved from the Internet: URL:seekingalpha.com/article/901141-halozyme-therapeutics-s-ceo-hosts-analyst-investor-day-conference-call-transcript?part=single [49 pages].
News Release, "Halozyme Therapeutics to Present at the 31st Annual J.P. Morgan Healthcare Conference," Published Jan. 3, 2013 [online][Retrieved Jan. 17, 2013][Retrieved from the Internet: URL:halozyme.com/Investors/News-Releases/News-Release-Details/2013/Halozyme-Therapeutics-to-Present-at-the-31st-Annual-JP-Morgan-Healthcare-Conference1132508/default.aspx [2 pages].
Letter/Written Disclosure of the Information Disclosure Statement for the above-referenced application, mailed on Feb. 4, 2013, 2 pages.
Adams et al., "The c-myc oncogene driven by immunoglobulin enhancers induces lymphoid malignancy in transgenic mice," Nature 318:533-538 (1985).
Alexander et al., "Expression of the c-myc oncogene under control of an immunoglobulin enhancer in E mu-myc transgenic mice," Mol. Cell Biol. 7:1436-1444 (1987).
Altschul, S., "Basic local alignment search tool," J Molec Biol 215(3):403-410 (1990).
Ansel, H., *Introduction to Pharmaceutical Dosage Forms*, Fourth Edition, Lea & Febiger:Philadelphia, p. 126 (1985).
Arming et al., "In vitro mutagenesis of PH-20 hyaluronidase from human sperm," Eur J Biochem 247(3):810-814 (1997).
Ashkenazi et al.,"Protection against endotoxic shock by a tum or necrosis factor receptor immunoadhesin,"PNAS 88:10535-10539 (1991).
Bacus et al., "Potential use of image analysis for the evaluation of cellular predicting factors for therapeutic response in breast cancers," Analyt Quant Cytol Histol, 19(4):316-328 (1997).
Belas et al., "Bacterial bioluminescence: isolation and expression of the luciferase genes from *Vibrio harveyi*,"Science 218(4574):791-793 (1982).
Blundell et al., "Determining the molecular basis for the pH-dependent interaction between the link module of human TSG-6 and hyaluronan," J Biol Chem 282(17):12976-12988 (2007).
Blundell et al., "The link module from ovulation—and inflammation-associated protein TSG-6 changes conformation on hyaluronan binding," J Biol Chem 278(49):49261-49270 (2003).
Blundell et al., "Towards a structure for a TSG-6.hyaluronan complex by modeling and NMR spectroscopy: insights into other members of the link module superfamily," J Biol Chem 280(18):18189-18201 (2005).
Bordier C., "Phase separation of integral membrane proteins in Triton X-114 solution," J Biol Chem. 256(4):1604-1607 (1981).
Brinster et al., "Regulation of metallothionein—thymidine kinase fusion plasmids injected into mouse eggs," Nature 296:39-42 (1982).
Busch, S. and P. Sassone-Corsi, "Dimers, leucine zippers and DNA-binding domains," Trends Genetics, 6:36-40 (1990).
Byrn et al., "Biological properties of a CD4 immunoadhesin," Nature 344:(6267)667-670 (1990).
Camenisch et al., "Disruption of hyaluronan synthase-2 abrogates normal cardiac morphogenesis and hyaluronan-mediated transformation of epithelium to mesenchyme" J Clin Invest 106:349-360 (2000).
Camp et al., "Automated subcellular localization and quantification of protein expression in tissue microarrays," Nature Medicine 8(11):1323-1327 (2002).
Carlsson et al., "Protein thiolation and reversible protein-protein conjugation. N-Succinimidyl 3-(2- pyridyldithio)propionate, a new heterobifunctional reagent," Biochem. J. 173(3):723-737 (1978).
Carrillo, H. and D. Lipman, "The multiple-sequence alignment problem in biology," SIAM J Applied Math 48:1073-1082 (1988).
Chao, H and A.P. Spicer, "Natural antisense mRNAs to hyaluronan synthase 2 inhibit hyaluronan biosynthesis and cell proliferation," J. Biol. Chem. 280(30):27513-27522 (2005).
Chapman et al., "Therapeutic antibody fragments with prolonged in vivo half-lives," Nature Biotech. 17:780-783 (1999).
Chenevert et al., "Monitoring early response of experimental brain tumors to therapy using diffusion magnetic resonance imaging," Clin Cancer Res. 3(9):1457-1466 (1997).
Cherr et al., "The dual functions of GPI-anchored PH-20: hyaluronidase and intracellular signaling," Matrix Biol., 20(8):515-525 (2001).
Cumber et al., "Structural features of the antibody-A chain linkage that influence the activity and stability of ricin A chain immunotoxins," Bioconj. Chem. 3(5):397-401 (1992).
Danilkovitch-Miagkova et al., "Hyaluronidase 2 negatively regulates RON receptor tyrosine kinase and mediates transformation of epithelial cells by jaagsiekte sheep retrovirus," Proc Natl Acad Sci USA. 100(8):4580-4585 (2003).
de Kruif et al., "Leucine zipper dimerized bivalent and bispecific scFv antibodies from a semi-synthetic antibody phage display library," J. Biol. Chem. 271(13):7630-7634 (1996).
de Wet et al., "Firefly luciferase gene: structure and expression in mammalian cells," Mol. Cell. Biol. 7(2):725-737 (1987).
DeBoer et al., "The tac promoter: a functional hybrid derived from the trp and lac promoters," Proc. Natl. Acad. Sci. USA 80:21-25 (1983).
Delpech et al., "Enzyme-linked hyaluronectin: a unique reagent for hyaluronan assay and tissue location and for hyaluronidase activity detection," Anal. Biochem. 229:35-41 (1995).
Devereux et al., "A comprehensive set of sequence analysis programs for the VAX," Nucleic Acids Research 12:387-395 (1984).
Deyev et al., "Design of multivalent complexes using the barnase*barstar module," Nat. Biotechnol. 21(12):1486-1492 (2003).
Edward et al., "4-Methylumbelliferone inhibits tumour cell growth and the activation of stromal hyaluronan synthesis by melanoma cell-derived factors," Br. J. Dermatol. 162(6):1224-1232 (2010).
Eisenhaber et al., "Prediction of potential GPI-modification sites in proprotein sequences," J. Mol. Biol. 292(3):741-758 (1999).
Ellison et al., "The nucleotide sequence of a human immunoglobulin C gamma gene," Nucleic Acids Research, 10(13):4071-4079 (1982).
Engström-Laurent et al., "Circulating hyaluronate in rheumatoid arthritis: relationship to inflammatory activity and the effect of corticosteroid therapy,"Ann. Rheum. Dis. 44(2):83-88 (1985).
Ernst et al., "Enzymatic degradation of glycosaminoglycans," Critical Reviews in Biochemistry and Molecular Biology 30(5):387-444 (1995).
Escher et al., "Bacterial luciferase alpha beta fusion protein is fully active as a monomer and highly sensitive in vivo to elevated temperature," PNAS 86(17):6528-6532 (1989).
Fankhauser, N. And P.Mäser, "Identification of GPI anchor attachment signals by a Kohonen self-organizing map," Bioinformatics 21(9) 1846-1852 (2005).
Fattom et al., "Comparative immunogenicity of conjugates composed of the *Staphylococcus aureus* type 8 capsular polysaccharide bound to carrier proteins by adipic acid dihydrazide or N-succinimidyl-3-(2-pyridyldithio)propionate," Infect Immun. 60(2):584-589 (1992).
Foran, D. and W. Brown, "Nucleotide sequence of the LuxA and LuxB genes of the bioluminescent marine bacterium *Vibrio fischeri*," Nucleic Acids Res. 16(2):777 (1988).
Frost et al., "Purification, cloning, and expression of human plasma hyaluronidase," Biochem. Biophys. Res. Commun. 236(1):10-15 (1997).
Frost, G. and R. Stern, "A microtiter-based assay for hyaluronidase activity not requiring specialized reagents," Anal. Biochem. 251:263-269 (1997).
Frost, G., "Recombinant human hyaluronidase (rHuPH2O): an enabling platform for subcutaneous drug and fluid administration," Expert Opin. Drug. Deliv. 4:427-440 2007.
Gardner et al., "The complete nucleotide sequence of an infectious clone of cauliflower mosaic virus by M13mp7 shotgun sequencing," Nucleic Acids Res. 9:2871-2888 (1981).
Gentz et al., "Parallel association of Fos and Jun leucine zippers juxtaposes DNA binding domains," Science 243(4899):1695-1699 (1989).

(56) References Cited

OTHER PUBLICATIONS

Gilbert, W. and L. Villa-Komaroff, "Useful proteins from recombinant bacteria," Scientific American 242(4):74-94 (1980).
Gordon et al., "Topographical localization of the C-terminal region of the voltage-dependent sodium channel from *Electrophorus electricus* using antibodies raised against a synthetic peptide," Proc. Natl. Acad Sci. 84(1):308-312 (1987).
Gribskov et al., "Sigma factors from *E. coli, B. subtilis*, phage SP01, and phage T4 are homologous proteins," Nucl. Acids Res. 14(16):6745-6763 (1986).
Grosschedl et al., "Introduction of a mu immunoglobulin gene into the mouse germ line: specific expression in lymphoid cells and synthesis of functional antibody," Cell 38:647-658 (1984).
Guiotto et al., "An improved procedure for the synthesis of branched polyethylene glycols (PEGs) with the reporter dipeptide Met-betaAla for protein conjugation," Bioorg. Med. Chem. Lett. 12:177-180 (2002).
Hamai et al., "Two distinct chondroitin sulfate ABC lyases. An endoeliminase yielding tetrasaccharides and an exoeliminase preferentially acting on oligosaccharides," J Biol Chem. 272(14):9123-9130 (1997).
Hammer et al., "Diversity of alpha-fetoprotein gene expression in mice is generated by a combination of separate enhancer elements," Science 235:53-58 (1987).
Hanahan, D., "Heritable formation of pancreatic beta-cell tumours in transgenic mice expressing recombinant insulin/simian virus 40 oncogenes," Nature 315(6015):115-122 (1985).
Harris, J. and R. Chess, "Effect of pegylation on pharmaceuticals," Nat Rev Drug Discov 2(3):214-221 (2003).
Haserodt et al., "A comparison of the sensitivity, specificity, and molecular weight accuracy of three different commercially available Hyaluronan ELISA-like assays," Glycobiology 21(2):175-183 (2011).
Herrera-Estrella et al., "Expression of chimaeric genes transferred into plant cells using a ti-plasmid-derived vector," Nature 303:209-213 (1984).
Herrera-Estrella et al., "Light-inducible and chloroplast-associated expression of a chimaeric gene introduced into *Nicotiana tabacum* using a Ti plasmid vector," Nature 310(5973):115-120 (1984).
Hibi et al., "Chondroitinase C activity of *Streptococcus intermedius*," FEMS-Microbiol-Lett. 48(2):121-124 (1989).
Hollenbaugh, D. and A. Aruffo, "Construction of immnoglobulin fusion proteins," in Current Protocols in Immunology, Chapter 10:Unit 10.19A.1-10.19A.11 (2002).
Hovingh et al., "Hyaluronidase activity in leeches (Hirudinea)," Comp Biochem Physiol B Biochem Mol Biol. 124(3):319-326 (1999).
Huang et al., "Claudin-3 gene silencing with siRNA suppresses ovarian tumor growth and metastasis," PNAS 106(9):3426-3430 (2009).
Huston et al., "Protein engineering of antibody binding sites: recovery of specific activity in an anti-digoxin single-chain Fv analogue produced in *Escherichia coli*," Proc. Natl. Acad. Sci. U.S.A. 85(16):5879-5883 (1988).
Itano et al., Altered hyaluronan biosynthesis in cancer progression. Seminars in cancer biology 18:268-274 (2008).
IUPAC, "IUPAC-IUB Commission on Biochemical Nomenclature. A one-letter notation for amino acid sequences. Tentative rules," J. Biol. Chem. 243(13):3557-3559 (1968).
IUPAC-IUB, "Abbreviated nomenclature of synthetic poypeptides-polymerized amino acids-revised recommendations," Commission on Biochemical Nomenclature, Biochemistry 11:1726-1731 (1972).
Järveläinen et al., "Extracellular matrix molecules: potential targets in pharmacotherapy," Pharmacol Rev 61(2):198-223 (2009).
Jay et al., "Construction of a general vector for efficient expression of mammalian proteins in bacteria: use of a synthetic ribosome binding site," Proc. Natl. Acad. Sci. USA 78:5543-5548 (1981).
Kahmann et al., "Localization and characterization of the hyaluronan-binding site on the link module from human TSG-6," Structure 8(7):763-774 (2000).
Kakizaki et al., "A novel mechanism for the inhibition of hyaluronan biosynthesis by 4-methylumbelliferone," J. Biol. Chem. 279:33281-33289 (2004).
Kelsey et al., "Species-and tissue-specific expression of human alpha 1-antitrypsin in transgenic mice," Genes And Devel. 1:161-171 (1987).
Kohda et al., "Solution structure of the link module: a hyaluronan-binding domain involved in extracellular matrix stability and cell migration," Cell 86(5):767-775 (1996).
Kollias et al., "Regulated expression of human A gamma-, beta-, and hybrid gamma beta-globin genes in transgenic mice: manipulation of the developmental expression patterns," Cell 46:89-94 (1986).
Kosaki et al., "Overproduction of hyaluronan by expression of the hyaluronan synthase Has2 enhances anchorage-independent growth and tumorigenicity" Cancer Res 59:1141-1145 (1999).
Krumlauf et al., Developmental regulation of alpha-fetoprotein genes in transgenic mice, Mol. Cell. Biol. 5:1639-1648 (1985).
Krupers et al., "Complexation of poly(ethylene oxide) with poly(acrylic acid-co-hydroxyethyl methacrylate)s," Eur. Polym J. 32:785-790 (1996).
Lalancette et al, "Characterization of an 80-kilodalton bull sperm protein identified as PH-20," Biol Reprod. 65(2):628-636 (2001).
Leder et al., "Consequences of widespread deregulation of the c-myc gene in transgenic mice: multiple neoplasms and normal development," Cell 45:485-495 (1986).
Lee et al., "A novel secretory tumor necrosis factor-inducible protein (TSG-6) is a member of the family of hyaluronate binding proteins, closely related to the adhesion receptor CD44," J Cell Biol 116(2):545-557 (1992).
Lesley et al., "Hyaluronan binding properties of a CD44 chimera containing the link module of TSG-6," J Biol Chem 277(29):26600-26608 (2002).
Lesley et al., "TSG-6 modulates the interaction between hyaluronan and cell surface CD44," J Biol Chem 279(24):25745-25754 (2004).
Liu et al., "Hyaluronan synthase 3 overexpression promotes the growth of TSU prostate cancer cells," Cancer Res. 61(13):5207-5214 (2001).
Lokeshwar et al., "Antitumor activity of hyaluronic acid synthesis inhibitor 4-methylumbelliferone in prostate cancer cells," Cancer Res 70(7):2613-2623 (2010).
Lorenz et al., "Isolation and expression of a cDNA encoding *Renilla reniformis* luciferase," Proc Natl Acad Sci USA 88(10):4438-4442 (1991).
MacDonald, R., "Expression of the pancreatic elastase I gene in transgenic mice," Hepatology 7:42S-51S(1987).
Magram et al., "Developmental regulation of a cloned adult beta-globin gene in transgenic mice," Nature 315:338-340 (1985).
Mahan et al., "Phase change enzyme immunoassay," Anal. Biochem. 162(1):163-170 (1987).
Mahoney et al., "Characterization of the interaction between tumor necrosis factor-stimulated gene-6 and heparin: implications for the inhibition of plasmin in extracellular matrix microenvironments," Journal of Biological Chemistry 280(29):27044-27055 (2005).
Mahoney et al., "Mapping the hyaluronan-binding site on the link module from human tumor necrosis factor-stimulated gene-6 by site-directed mutagenesis," J Biol Chem 276(25):22764-22771 (2001).
Mason et al., "The hypogonadal mouse: reproductive functions restored by gene therapy," Science 234:1372-1378 (1986).
McLachlan, A. and M. Stewart, "Tropomyosin coiled-coil interactions: evidence for an unstaggered structure," J. Mol. Biol. 98(2):293-304 (1978).
Mehvar et al., "Modulation of the pharmacokinetics and pharmacodynamics of proteins by polyethylene glycol conjugation," J. Pharm. Pharmaceut. Sci. 3(1):125-136 (2000).
Michelacci et al., "Chondroitinase C from Flavobacterium heparinum," J. Biol. Chem. 251:1154-1158 (1976).
Milner et al., "TSG-6: a multifunctional protein associated with inflammation," J Cell Sci, 116(Pt.10):1863-1873 (2003).
Molina et al., "Global proteomic profiling of phosphopeptides using electron transfer dissociation tandem mass spectrometry," Proc Natl Acad Sci USA 104(7):2199-2204 (2007).

(56) References Cited

OTHER PUBLICATIONS

Monfardini et al, "A branched monomethoxypoly(ethylene glycol) for protein modification," Bioconjugate Chem. 6:62-69 (1995).
Morohashi et al., "Study of hyaluronan synthase inhibitor, 4-methylumbelliferone derivatives on human pancreatic cancer cell (KP1-NL)," Biochem Biophys Res Commun. 345(4):1454-1459 (2006).
Müller et al., "A dimeric bispecific miniantibody combines two specificities with avidity," FEBS Lett. 432(1-2):45-49 (1998).
Müller et al., "The first constant domain (C(H)1 and C(L)) of an antibody used as heterodimerization domain for bispecific miniantibodies," FEBS Lett. 422(2):259-264 (1998).
Nakazawa et al., "4-methylumbelliferone, a hyaluronan synthase suppressor, enhances the anticancer activity of gemcitabine in human pancreatic cancer cells," Cancer Chemother Pharmacol 57(2):165-170 (2006).
Needleman, S. and C. Wunsch "A general method applicable to the search for similarities in the amino acid sequence of two proteins," J Mol Biol. 48:443-453 (1970).
Nentwich et al., "A novel allelic variant of the human TSG-6 gene encoding an amino acid difference in the CUB module. Chromosomal localization, frequency analysis, modeling, and expression," J Biol Chem 277:15354-15362 (2002).
Newton et al., "Angiogenin single-chain immunofusions: influence of peptide linkers and spacers between fusion protein domains," Biochemistry 35(2):545-553 (1996).
Nishida et al., "Antisense inhibition of hyaluronan synthase-2 in human articular chondrocytes inhibits proteoglycan retention and matrix assembly," J. Biol. Chem. 274(31):21893-21899 (1999).
Nykopp et al., "Hyaluronan synthases (HAS1-3) and hyaluronidases (HYAL1-2) in the accumulation of hyaluronan in endometrioid endometrial carcinoma," BMC Cancer 10:512 (2010).
O'Shea et al., "Preferential heterodimer formation by isolated leucine zippers from fos and jun," Science, 245(4918):646-648 (1989).
Ohya, T., and Y. Kaneko, "Novel hyaluronidase from streptomyces," Biochim. Biophys. Acta 198:607-609 (1970).
Omaetxebarria et al., "Computational approach for identification and characterization of GPI-anchored peptides in proteomics experiments," Proteomics 7(12):1951-1960 (2007).
Ornitz et al., "Elastase I promoter directs expression of human growth hormone and SV40 T antigen genes to pancreatic acinar cells in transgenic mice," Cold Spring Harbor Symp. Quant. Biol. 50:399-409 (1986).
Pearson, W. and D. Lipman, "Improved tools for biological sequence comparison," Proc. Natl. Acad. Sci. USA 851:2444-2448 (1988).
Pham et al., "Large-scale transient transfection of serum-free suspension-growing HEK293 EBNA1 cells: peptone additives improve cell growth and transfection efficiency," Biotechnology and Bioengineering 84:332-342 (2003).
Pierleoni et al., PredGPI: a GPI-anchor predictor, BMC Bioinformatics 9:392, 11 pages (2008).
Pinkert et al., "An albumin enhancer located 10 kb upstream functions along with its promoter to direct efficient, liver-specific expression in transgenic mice," Genes and Devel. 1:268-276 (1987).
Pirinen et al., "Prognostic value of hyaluronan expression in non-small-cell lung cancer: Increased stromal expression indicates unfavorable outcome in patients with adenocarcinoma," Int J Cancer 95(1):12-17 (2001).
Plenat et al., "Formaldehyde fixation in the third millennium,"Ann Pathol 21(1):29-47 (2001). [in French] English language abstract included, 1 page.
Prasher et al., "Primary structure of the Aequorea victoria green-fluorescent protein," Gene 111(2):229-233 (1987).
Prasher et al., "Sequence comparisons of complementary DNAs encoding aequorin isotypes,"Biochem. 26(5):1326-1332 (1987).
Readhead et al., "Expression of a myelin basic protein gene in transgenic shiverer mice: correction of the dysmyelinating phenotype," Cell 48:703-712 (1987).
Ridgway et al., "Knobs-into-holes' engineering of antibody CH3 domains for heavy chain heterodimerization," Protein Engineering, 9(7):617-621 (1996).
Roberts et al., "Chemistry for peptide and protein PEGylation," Advanced Drug Delivery Review 54:459-476 (2002).
Sato et al., "Cloning and expression in Escherichia coli of the gene encoding the Proteus vulgaris chondroitin ABC lyase," Appl. Microbiol. Biotechnol. 41(1):39-46 (1994).
Sato, H., "Enzymatic procedure for site-specific pegylation of proteins," Adv. Drug Deliv. Rev. 54:487-504 (2002).
Sawhney et al., "Bioerodible hydrogels based on photopolymerized poly(ethylene glycol)-co poly(hydroxyl acid) Diacrylate Macromers," Macromolecules 26:581-587 (1993).
Schmiedl et al., "Expression of a bispecific dsFv-dsFv' antibody fragment in Escherichia coli," Protein Eng. 13:725-734 (2000).
Schwartz and Dayhoff, eds., Atlas of Protein Science and Structure, National Biomedical Research Foundation, pp. 353-358 (1979).
Shani, M., "Tissue-specific expression of rat myosin light-chain," Nature 314:283-286 (1985).
Shieh, A., "Biomechanical forces shape the tumor microenvironment," Ann Biomed Eng 39(5):1379-1389 (2011).
Simpson et al., "Inhibition of prostate tumor cell hyaluronan syntheiis impairs subcutaneous growth and vascularization in immunocompromised mice," Am J Pathol 161(3):849-857 (2002).
Simpson et al., "Manipulation of hyaluronan synthase expression in prostate adenocarcinoma cells alters pericellular matrix retention and adhesion to bone marrow endothelial cells," J. Biol. Chem. 277(12):10050-10057 (2002).
Smith, T. and M. Waterman, "Comparison of biosequences," Advances in Applied Mathematics 2:482-489 (1981).
Stuhlmeier, K., "Effects of leflunomide on hyaluronan synthases (HAS): NF-kappa B-independent suppression of IL-1-induced HAS1 transcription by leflunomide," J Immunol 174(11):7376-7382 (2005).
Swift et al., "Tissue-specific expression of the rat pancreatic elastase I gene in transgenic mice," Cell 38(3):639-646 (1984).
Takahashi et al., "A fluorimetric Morgan-Elson assay method for hyaluronidase activity," Anal. Biochem. 322:257-263 (2003).
Tammi et al., "Hyaluronan in human tumors: pathobiological and prognostic messages from cell-associated and stromal hyaluronan," Seminar in Cancer Biology 18:288-395 (2008).
Terskikh et al., "Peptabody': a new type of high avidity binding protein," Proc Natl Acad Sci USA 94(5):1663-1668 (1997).
Thompson et al., "Enzymatic depletion of tumor hyaluronan induces antitumor responses in preclinical animal models," Molecular Cancer Therapeutics 9(11):3052-3064 (2010).
Thorpe et al., "New coupling agents for the synthesis of immunotoxins containing a hindered disulfide bond with improved stability in vivo," Cancer Res. 47(22):5924-5931 (1987).
Tkalec et al., "Isolation and expression in Escherichia coli of cslA and cslB, genes coding for the chondroitin sulfate-degrading enzymes chondroitinase AC and chondroitinase B, respectively, from Flavobacterium heparinum," Applied and Environmental Microbiology 66(1):29-35 (2000).
Tsubery et al., "Prolonging the action of protein and peptide drugs by a novel approach of reversible polyethylene glycol modification.," J Biol. Chem 279(37):38118-38124 (2004).
Tsuda et al., "Substrate specificity studies of flavobacterium chondroitinase C and heparitinases towards the glycosaminoglycan—protein linkage region. Use of a sensitive analytical method developed by chromophore-labeling of linkage glycoserines using dimethylaminoazobenzenesulfonyl chloride," Eur. J. Biochem. 262:127-133 (1999).
Turner, R. and R. Tijian,"Leucine repeats and an adjacent DNA binding domain mediate the formation of functional cFos-cJun heterodimers," Science 243(4899):1689-1694 (1989).
Udabage L., "Antisense-mediated suppression of hyaluronan synthase 2 inhibits the tumorigenesis and progression of breast cancer" Cancer Res. 65(14):6139-6150 (2005).
Udenfriend, S. and K. Kodukula, "Prediction of omega site in nascent precursor of glycosylphosphatidylinositol protein," Methods Enzymol. 250:571-582 (1995).

(56) References Cited

OTHER PUBLICATIONS

USP XXII-NF XVII, United States Pharmacopeia Convention, Inc, Rockville, MD., pp. 644-645 (1990).

Veronese et al., "Branched and Linear Poly(Ethylene Glycol): Influence of the Polymer Structure on Enzymological, Pharmacokinetic, and Immunological Properties of Protein Conjugates," J. Bioactive Compatible Polymers 12:197-207 (1997).

Wagner et al., "Nucleotide sequence of the thymidine kinase gene of herpes simplex virus type 1," Proc. Natl. Acad. Sci. USA 78:1441-1445 (1981).

Walden et al., "Major histocompatibility complex-restricted and unrestricted activation of helper T cell lines by liposome-bound antigens," J. Mol. Cell Immunol. 2(4):191-197 (1986).

Watson et al., *Molecular Biology of the Gene*, 4th Edition, The Benjamin/Cummings Pub. Co., p. 224 (1987).

Wawrzynczak et al., "Molecular and biological properties of an abrin A chain immunotoxin designed for therapy of human small cell lung cancer," Br. J. Cancer 66(2):361-366 (1992).

Whatcott et al., "Targeting the tumor microenvironment in cancer: why hyaluronidase deserves a second look," Cancer Discov. 1(4):291-296 (2011).

Whitlow et al., "An improved linker for single-chain Fv with reduced aggregation and enhanced proteolytic stability," Protein Engineering 6(8):989-995 (1993).

Yamagata et al., "Purification and properties of bacterial chondroitinases and chondrosulfatases," J. Biol. Chem. 243: 1523-1535 (1968).

Yamamoto et al., "Identification of a functional promoter in the long terminal repeat of *Rous sarcoma* virus," Cell 22:787-797 (1980).

Yang et al., "Purification and characterization of heparinase from *Flavobacterium* heparinum," J. Biol. Chem. 160(30):1849-1857 (1985).

Yoshihara et al., "A hyaluronan synthase' suppressor, 4-methylumbelliferone, inhibits liver metastasis of melanoma cells," FEBS Lett 579(12):2722-2726 (2005).

Zalipsky, S., "Chemistry of polyethylene glycol conjugates with biologically active molecules," Adv. Drug Del. Rev. 16:157-182 (1995).

Zhao, X. and J. Harris, "Novel degradable poly(ethylene glycol) esters for delivery," in Poly(ethylene glycol), Chemistry and Biological Applications, ACS Symposium Series 680, Hams, J. And S. Zalipsky, (eds), 458-472 (1997).

US 8,846,034 B2

COMPANION DIAGNOSTIC FOR ANTI-HYALURONAN AGENT THERAPY AND METHODS OF USE THEREOF

RELATED APPLICATIONS

Benefit of priority is claimed to U.S. Provisional Application Ser. No. 61/628,187, filed Oct. 24, 2011, entitled "Companion Diagnostic For Hyaluronan-Degrading Enzyme Therapy and Methods of Use Thereof," to U.S. Provisional Application No. 61/559,011, filed Nov. 11, 2011, entitled "Companion Diagnostic for Hyaluronan-Degrading Enzyme Therapy and Methods of Use Thereof," to U.S. Provisional Application No. 61/630,765, filed Dec. 16, 2011, entitled "Companion Diagnostic for Hyaluronan-Degrading Enzyme Therapy and Methods of Use Thereof," and to U.S. Provisional Application No. 61/714,700, filed Oct. 16, 2012, entitled "Companion Diagnostic for Anti-Hyaluronan Agent Therapy and Methods of Use Thereof. The subject matter of each of the above-noted applications is incorporated by reference in its entirety.

This application is related to International PCT Patent Application No. PCT/US2012/061743, filed the same day herewith, entitled "Companion Diagnostic for Anti-Hyaluronan Agent Therapy and Methods of Use Thereof," which claims priority to U.S. Provisional Application Ser. Nos. 61/628,187; 61/559,011; 61/630,765 and 61/714,700.

The subject matter of the above-noted related application is incorporated by reference in its entirety.

INCORPORATION BY REFERENCE OF SEQUENCE LISTING PROVIDED ON COMPACT DISCS

An electronic version on compact disc (CD-R) of the Sequence Listing is filed herewith in duplicate (labeled Copy 1 and Copy 2), the contents of which are incorporated by reference in their entirety. The computer-readable file on each of the aforementioned compact discs, created on Oct. 24, 2012, is identical, 1827 kilobytes in size, and titled 3096seq.001.txt.

FIELD OF INVENTION

Methods and diagnostic agents for identification of subjects for cancer treatment with a hyaluronan-degrading enzyme are provided. Diagnostic agents for the detection and quantification of hyaluronan in a biological sample and monitoring cancer treatment with a hyaluronan-degrading enzyme are provided. Combinations and kits for use in practicing the methods also are provided.

BACKGROUND

Hyaluronan-degrading enzymes have been used therapeutically, typically as dispersing and spreading agents in combination with other therapeutic agents. Hyaluronan-degrading enzymes also can be used in single-agent therapy for the treatment of hyaluronan-associated diseases and disorders. For example, tumors and cancers are associated with accumulation of hyaluronan and treatment with a hyaluronan-degrading enzyme inhibits the growth of tumor and increases vascular perfusion and improves delivery of chemotherapeutic agents to the tumor. There exists a need for methods and reagents for improving treatment of patients who are treated with hyaluronan-degrading enzymes.

SUMMARY

Provided herein is a method for selecting a subject for treatment of a tumor with an anti-hyaluronan agent, for example, a hyaluronan-degrading enzyme. In the provided method, a tissue or body fluid sample from a subject with a tumor or cancer is contacted with a hyaluronan binding protein (HABP) that has not been prepared from or isolated from animal cartilage. Binding of the hyaluronan binding protein to the sample is detected, thereby determining the amount of hyaluronan in the sample, wherein if the amount of hyaluronan in the sample is at or above a predetermined threshold level, selecting the subject for treatment with an anti-hyaluronan agent, for example, a hyaluronan degrading enzyme.

Provided herein is a method for selecting a subject for treatment of a tumor with an anti-hyaluronan agent, for example a hyaluronan-degrading enzyme, wherein a body fluid from a subject with a tumor or cancer is contacted with a hyaluronan binding protein (HABP) that has not been prepared from or isolated from animal cartilage and binding of the HABP to the sample is effected by a solid-phase binding assay with a colorimetric or fluorescent signal, thereby determining the amount of hyaluronan in the sample, wherein a subject is selected for treatment with am anti-hyaluronan agent, for example a hyaluronan degrading enzyme, when the predetermined threshold level is high HA. In some examples of the method, the predetermined threshold level is at least or above 0.025 µg HA/ml of sample, 0.030 µg/ml, 0.035 µg/ml, 0.040 µg/ml, 0.045 µg/ml, 0.050 µg/ml, 0.055 mg/ml, 0.060 µg/ml, 0.065 µg/ml, 0.070 µg/ml, 0.08 µg/ml, 0.09 µg/ml. 0.1 µg/ml, 0.2 µg/ml, 0.3 µg/ml or higher.

Provided herein is a method for selecting a subject for treatment of a tumor with an anti-hyaluronan agent, for example a hyaluronan-degrading enzyme, wherein a tumor tissue sample from a subject with a tumor or cancer is contacted with a hyaluronan binding protein (HABP) that has not been prepared from or isolated from animal cartilage and binding of the HABP to the sample is effected by histochemistry, thereby determining the amount of hyaluronan in the sample, wherein a subject is selected for treatment with an anti-hyaluronan agent, for example a hyaluronan degrading enzyme, when the predetermined threshold level is an HA score of at least +2 ($HA^{+2}$) or at least +3 ($HA^{+3}$). In some examples, the predetermined threshold level is an HA score of at least +3 ($HA^{+3}$) (high levels). In other examples, the predetermined threshold level is at least a percent HA positive pixels in tumor (cells and stroma) to total stain in tumor tissue of at least 10%, 10% to 25% or greater than 25%. For example, the predetermined threshold level is at least a percent HA positive pixels in tumor (cells and stroma) to total stain in tumor tissue of at least 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39% or 40%.

Also provided herein is a method for selecting a subject for treatment of a tumor with an anti-hyaluronan agent, for example a hyaluronan-degrading enzyme, wherein the subject is then treated with the anti-hyaluronan agent, for example a hyaluronan-degrading enzyme. In some examples, the anti-hyaluronan agent is a hyaluronan-degrading enzyme that is administered in a dosage range amount of between or about between 0.01 µg/kg (of the subject) to 50 µg/kg, 0.01 µg/kg to 20 µg/kg, 0.01 µg/kg to 15 µg/kg, 0.05 µg/kg to 10 µg/kg, 0.75 µg/kg to 7.5 µg/kg or 1.0 µg/kg to 3.0 µg/kg and a frequency of administration is twice weekly, once weekly, once every 14 days, once every 21 days or once every month. In particular examples of the method, a corticosteroid is administered prior to administration of a hyaluronan-degrading enzyme or after administration of the hyaluronan-degrading enzyme, typically in an amount sufficient to ameliorate an adverse effect in the subject from the administered hyaluronan-degrading enzyme. For example, the amount of corticosteroid administered is between at or about 0.1 to 20 mgs, 0.1 to 15 mgs, 0.1 to 10 mgs, 0.1 to 5 mgs, 0.2 to 20 mgs, 0.2 to 15 mgs, 0.2 to 10 mgs, 0.2 to 5 mgs, 0.4 to 20 mgs, 0.4 to 15 mgs, 0.4 to 10 mgs, 0.4 to 5 mgs, 0.4 to 4 mgs, 1 to 20 mgs, 1 to 15 mgs or 1 to 10 mgs.

Also provided herein is a method for predicting efficacy of treatment of a subject with an anti-hyaluronan agent, for example a hyaluronan degrading enzyme. In the provided method, a tissue or body fluid sample from a subject who is or has been treated with an anti-hyaluronan agent, for example a hyaluronan degrading enzyme, is contacted with a hyaluronan binding protein (HABP) that has not been prepared from or isolated from animal cartilage and binding of the hyaluronan binding protein to the sample is detected, thereby determining the amount of hyaluronan in the sample, wherein detection of a decrease in hyaluronan compared to before treatment with the anti-hyaluronan agent (e.g. hyaluronan-degrading enzyme) or the last dose of anti-hyaluronan agent (e.g. hyaluronan-degrading enzyme) indicates that the treatment is effective.

Also provided herein is a method for monitoring treatment of a subject with an anti-hyaluronan agent (e.g. a hyaluronan degrading enzyme). In the provided method, a tissue or body fluid sample from a subject with a tumor or cancer is contacted with a hyaluronan binding protein (HABP) that has not been prepared from or isolated from animal cartilage and the amount of hyaluronan binding protein that binds to the sample is detected, thereby determining the amount of hyaluronan in the sample, and the level of hyaluronan is compared to a control or reference sample to thereby determine the amount of hyaluronan in the sample relative to the control or reference sample, wherein the amount of hyaluronan is an indicator of the progress of treatment.

Also provided herein are methods for predicting efficacy of treatment of a subject with an anti-hyaluronan agent (e.g. a hyaluronan degrading enzyme) and monitoring treatment of a subject with an anti-hyaluronan agent (e.g. a hyaluronan degrading enzyme) wherein treatment is altered based on the determined amount of hyaluronan in the sample relative to the control or reference sample, such that if the amount of hyaluronan in the sample is at or above the amount in the control or reference sample, treatment is continued or escalated by increasing the dosage and/or dose schedule; or if the amount of hyaluronan in the sample is below the amount in the control or reference sample, treatment is continued, reduced by decreasing the dosage and/or dose schedule, or terminated. In some examples, the control or reference sample is a sample from a healthy subject, is a baseline sample from the subject prior to treatment with an anti-hyaluronan agent (e.g. hyaluronan-degrading enzyme) or is a sample from a subject prior to the last dose of anti-hyaluronan agent (e.g. hyaluronan-degrading enzyme). In some examples, the subject has a tumor or cancer and the sample is a tumor tissue sample and detection is effected by histochemistry. In other examples, the subject has a tumor or cancer and the sample is a body fluid and detection is effected by a solid-phase binding assay. In some examples, the solid-phase binding assay is a microtiter plate assay and binding is detected colorimetrically or via fluorescence.

In any of the methods provided herein, the step of contacting the sample with a HABP can be effected at between or about between pH 5.6 to 6.4. For example, the step of contacting the sample with a HABP is effected at a pH of about 5.8, 5.9, 6.0, 6.1 or 6.2. In some examples, the HABP specifically binds to HA with a binding affinity represented by the dissociation constant (Kd) of at least less than or less than or $1\times10^{-7}$ M, $9\times10^{-8}$ M, $8\times10^{-8}$ M, $7\times10^{-8}$ M, $6\times10^{-8}$ M, $5\times10^{-8}$ M, $4\times10^{-8}$ M, $3\times10^{-8}$ M, $2\times10^{-8}$ M, $1\times10^{-8}$ M, $9\times10^{-9}$ M, $8\times10^{-9}$ M, $7\times10^{-9}$ M, $6\times10^{-9}$ M, $5\times10^{-9}$ M, $4\times10^{-9}$ M, $3\times10^{-9}$ M, $2\times10^{-9}$ M, $1\times10^{-9}$ M or lower Kd.

In any of the methods provided herein, the HABP can be generated recombinantly or synthetically. In some examples, the HABP contains a link module. In other examples, the HABP contains two or more link modules. In further examples, the link module or modules are the only HABP portion of the molecule. Thus, provided herein are methods wherein the HABP contains a link module selected from among CD44, LYVE-1, HAPLN1/link protein, HAPLN2, HAPLN3, HAPLN4, aggrecan, versican, neurocan, brevican, phosphacan, TSG-6, Stabilin-1, Stabilin-2, CAB61358 and KIAA0527. In some examples of the method, the HABP contains a portion of a CD44, LYVE-1, HAPLN1/link protein, HAPLN2, HAPLN3, HAPLN4, aggrecan, versican, neurocan, brevican, phosphacan, TSG-6, Stabilin-1, Stabilin-2, CAB61358 or KIAA0527 including a link module or a sufficient portion of a link module to bind HA. In a particular example, the HABP is a tumor necrosis factor-stimulated Gene (TSG-6) protein or a link module of TSG-6 or a sufficient portion of a link module of TSG-6 to bind HA. In other examples of the method herein, the HABP contains a G1 domain of a type C hyaluronan binding protein, for example, a G1 domain selected from among Aggrecan G1, Versican G1, Neurocan G1 and Brevican G1. In particular examples, the G1 domain is the only HABP portion of the molecule.

In some examples of the methods provided herein, the HABP contains the sequence of amino acids set forth in any of SEQ ID NOS: 207, 222, 360, 361, 371-394, 416-418 and 423-426 or has a sequence of amino acids that exhibits at least 65%, 70%, 75%, 80%, 85%, 90%, 91%, 92%, 93%, 95%, 95%, 96%, 97%, 98%, 99% or more sequence identity to a sequence of amino acids set forth in any of SEQ ID NOS: 207, 222, 360, 361, 371-394, 416-418 and 423-426 and specifically binds HA, or is an HA-binding domain thereof or a sufficient portion thereof to specifically bind to HA. In an exemplary example, the HABP contains a TSG-6 link module (LM) or a sufficient portion thereof that specifically binds HA. For example, the TSG-6-LM contains the sequence of amino acids set forth in SEQ ID NO: 207, 360, 417 or 418, or a sequence of amino acids comprising at least 65% amino acid sequence identity to the sequence of amino acids set forth in SEQ ID NO: 207, 360, 417 or 418 and specifically binds HA. In specific examples of the method, the HABP contains a link module set forth in SEQ ID NO:207 or a sequence of amino acids comprising at least 65% amino acid sequence identity to the sequence of amino acids set forth in SEQ ID NO:207 and specifically binds HA. In other examples, the HABP contains a link module that exhibits at least 70%, 75%, 80%, 85%, 90%, 91%, 92%, 93%, 94%, 95%, 96%, 97%, 98%, or 99% sequence identity to the sequence of amino acids set forth in SEQ ID NO: 207, 360, 417 or 418, whereby the HABP specifically binds HA.

In some examples of the method provided herein, the TSG-6 link module is modified to reduce or eliminate binding to heparin. For example, binding to heparin is reduced at least 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold or more. In some examples of the method provided herein, TSG-6 link module contains an amino acid replacement at an amino acid position corresponding to amino acid residue 20, 34, 41, 54, 56, 72 or 84 set forth in SEQ ID NO:360, whereby a corresponding amino acid residue is identified by alignment to a TSG-6-LM set forth in SEQ ID NO:360. For example, the amino acid replacement is in a TSG-6-LM set forth in SEQ ID NO:207 and the amino acid replacement or replacements is at amino acid residue 21, 35, 42, 55, 57, 73 or 85. The amino acid replacement can be to a non-basic amino acid residue selected from among Asp (D), Glu (E), Ser (S), Thr (T), Asn (N), Gln (Q), Ala (A), Val (V), Ile (I), Leu (L), Met (M), Phe (F), Tyr (Y) and Trp (W). In a further example, the TSG-6 link module contains an amino acid replacement corresponding to amino acid replacement K20A, K34A or K41A in a TSG-6-LM set forth in SEQ ID NO:360 or the replacement at the corresponding residue in another TSG-6-LM. In another example, the TSG-6 link module contains amino acid replacements corresponding to amino acid replacements K20A, K34A and K41A in a TSG-6-LM set forth in SEQ ID NO:360 or the replacement at the corresponding residue in another TSG-6-LM. For example, the HABP contains a link module set forth in SEQ ID NO:361 or 416 or a sequence of amino acids comprising at least 65% amino acid sequence identity to the sequence of amino acids set forth in SEQ ID NO:361 or 416 that specifically binds HA.

In some examples of the methods provided herein, the HABP contains a link module that exhibits at least 70%, 75%, 80%, 85%, 90%, 91%, 92%, 93%, 94%, 95%, 96%, 97%, 98%, or 99% sequence identity to the sequence of amino acids set forth in SEQ ID NO:361 or 416, whereby the HABP specifically binds HA. In particular examples, the HABP contains a link module set forth in SEQ ID NO:361 or SEQ ID NO:416. In other examples, the link module is the only TSG-6 portion of the HABP. In some examples of the methods provided herein, the HABP is a multimer containing a first HA-binding domain linked directly or indirectly via a linker to a multimerization domain and a second HA-binding domain linked directly or indirectly via a linker to a multimerization domain. For example, the HA-binding domain is a link module or a G1 domain. The first and second HA-binding domain can be the same or different. In a particular example, the first and second HA-binding domain is a TSG-6 link module, a variant thereof or a sufficient portion thereof that specifically binds to HA. For example, the TSG-6-LM contains a sequence of amino acids set forth in SEQ ID NO: 207, 360, 361, 416, 417 or 418 or a sequence of amino acids comprising at least 65% amino acid sequence identity to the sequence of amino acids set forth in SEQ ID NO: 207, 360, 361, 416, 417 or 418 that specifically binds HA. For example, the link module exhibits at least 70%, 75%, 80%, 85%, 90%, 91%, 92%, 93%, 94%, 95%, 96%, 97%, 98%, or 99% sequence identity to the sequence of amino acids set forth in SEQ ID NO: 207, 360, 361, 416, 417 or 418, whereby the HABP specifically binds HA. In some methods provided herein, the link module contains a sequence of amino acids set forth in SEQ ID NO: 207, 360, 361, 416, 417 or 418.

In the provided methods, the HABPs, HA-binding domains, link modules or portions thereof can be linked to a multimerization domain that is selected from among an immunoglobulin constant region (Fc), a leucine zipper, complementary hydrophobic regions, complementary hydrophilic regions, compatible protein-protein interaction domains, free thiols that form an intermolecular disulfide bond between two molecules, and a protuberance-into-cavity and a compensatory cavity of identical or similar size that form stable multimers. In a particular example, the multimerization domain is an Fc domain or a variant thereof that effects multimerization. For example, the Fc domain is from an IgG, IgM or an IgE, or the Fc domain has a sequence of amino acids set forth in SEQ ID NO:359. In some instances of the methods provided herein, the HABP is a fusion protein that contains a TSG-6 link module and an immunoglobulin Fc domain. For example, the HABP is TSG-6-LM-Fc that has a sequence of amino acids set forth in SEQ ID NO: 212 or a sequence of amino acids that exhibits at least 65% amino acid sequence identity to SEQ ID NO:212 and specifically binds HA, such as a sequence of amino acids that exhibits at least 70%, 75%, 80%, 85%, 90%, 91%, 92%, 93%, 94%, 95%, 96%, 97%, 98%, or 99% sequence identity to the sequence of amino acids set forth in SEQ ID NO:212, whereby the HABP specifically binds HA. In particular examples, the HABP has a sequence of amino acids set forth in SEQ ID NO:212 or 215. In any of the methods provided herein, the HABP can be TSG-6-LM-Fc/ΔHep that has a sequence of amino acids set forth in SEQ ID NO: 215 or a sequence of amino acids that exhibits at least 65% amino acid sequence identity to SEQ ID NO:215 and specifically binds HA, such as a sequence of amino acids that exhibits at least 70%, 75%, 80%, 85%, 90%, 91%, 92%, 93%, 94%, 95%, 96%, 97%, 98%, or 99% sequence identity to the sequence of amino acids set forth in SEQ ID NO:215, whereby the HABP specifically binds HA.

In particular methods provided herein, the HABP is a TSG-6 or hyaluronan-binding region thereof. In some examples of the methods provided herein, the HABP or TSG-6 has a binding affinity to HA of at least $1\times10^8$ $M^{-1}$, $2\times10^8$ $M^{-1}$, $3\times10^8$ $M^{-1}$, $4\times10^8$ $M^{-1}$, $5\times10^8$ $M^{-1}$, $6\times10^8$ $M^{-1}$, $7\times10^8$ $M^{-1}$, $8\times10^8$ $M^{-1}$, $9\times10^8$ $M^{-1}$, $1\times10^9$ $M^{-1}$ or higher. In other examples, the HABP or TSG-6 is conjugated to a detectable moiety that is detectably labeled or that can be detected. For example, the HABP or TSG-6 is biotinylated.

In some examples of the methods provided herein the sample is a stromal tissue sample, such as a stromal tissue sample from a tumor. The tissue sampled in the methods herein can be fixed, paraffin-embedded, fresh, or frozen. In some examples, the sample is taken from a biopsy from a solid tumor, for example, obtained by needle biopsy, CT-guided needle biopsy, aspiration biopsy, endoscopic biopsy, bronchoscopic biopsy, bronchial lavage, incisional biopsy, excisional biopsy, punch biopsy, shave biopsy, skin biopsy, bone marrow biopsy, and the Loop Electrosurgical Excision Procedure (LEEP). In other examples, the sample is a fluid sample that is a blood, serum, urine, sweat, semen, saliva, cerebral spinal fluid, or lymph sample. In any of the methods provided herein the sample can be obtained from a mammal. In an exemplary example, the mammal is a human.

In any of the methods provided herein, the tumor can be of a cancer selected from among breast cancer, pancreatic cancer, ovarian cancer, colon cancer, lung cancer, non-small cell lung cancer, in situ carcinoma (ISC), squamous cell carcinoma (SCC), thyroid cancer, cervical cancer, uterine cancer, prostate cancer, testicular cancer, brain cancer, bladder cancer, stomach cancer, hepatoma, melanoma, glioma, retinoblastoma, mesothelioma, myeloma, lymphoma, and leukemia. In some examples, the tumor is of a cancer that is a late-stage cancer, a metastatic cancer and an undifferentiated cancer.

In any of the methods provided herein, the anti-hyaluronan agent can be an agent that degrades hyaluronan or can be an agent that inhibits the synthesis of hyaluronan. For example, the anti-hyaluronan agent can be a hyaluronan degrading enzyme. In another example, the anti-hyaluronan agent or is an agent that inhibits hyaluronan synthesis. For example, the anti-hyaluronan agent is an agent that inhibits hyaluronan synthesis such as a sense or antisense nucleic acid molecule against an HA synthase or is a small molecule drug. For example, an anti-hyaluronan agent is 4-methylumbelliferone (MU) or a derivative thereof, or leflunomide or a derivative thereof. Such derivatives include, for example, a derivative of 4-methylumbelliferone (MU) that is 6,7-dihydroxy-4-methyl coumarin or 5,7-dihydroxy-4-methyl coumarin.

In further examples of the methods provided herein, the hyaluronan degrading enzyme is a hyaluronidase. In some examples, the hyaluronan-degrading enzyme is a PH20 hyaluronidase or truncated form thereof to lacking a C-terminal glycosylphosphatidylinositol (GPI) attachment site or a portion of the GPI attachment site. In specific examples, the hyaluronidase is a PH20 selected from a human, monkey, bovine, ovine, rat, mouse or guinea pig PH20. For example, the hyaluronan-degrading enzyme is a human PH20 hyaluronidase that is neutral active and N-glycosylated and is selected from among (a) a hyaluronidase polypeptide that is a full-length PH20 or is a C-terminal truncated form of the PH20, wherein the truncated form includes at least amino acid residues 36-464 of SEQ ID NO:1, such as 36-481, 36-482, 36-483, where the full-length PH20 has the sequence of amino acids set forth in SEQ ID NO:2; or (b) a hyaluronidase polypeptide comprising a sequence of amino acids having at least 85%, 86%, 87%, 88%, 89%, 90%, 91%, 92%, 93%, 94%, 95%, 96%, 97%, 98%, 99% or more sequence identity with the polypeptide or truncated form of sequence of amino acids set forth in SEQ ID NO:2; or (c) a hyaluronidase polypeptide of (a) or (b) comprising amino acid substitutions, whereby the hyaluronidase polypeptide has a sequence of amino acids having at least 85%, 86%, 87%, 88%, 89%, 90%, 91%, 92%, 93%, 94%, 95%, 96%, 97%, 98%, 99% or more sequence identity with the polypeptide set forth in SEQ ID NO:2 or the with the corresponding truncated forms thereof. In exemplary examples, the hyaluronan-degrading enzyme is a PH20 that comprises a composition designated rHuPH20.

In other examples, the anti-hyaluronan agent is a hyaluronan degrading enzyme that is modified by conjugation to a polymer. The polymer can be a PEG and the anti-hyaluronan agent a PEGylated hyaluronan degrading enzyme. Hence, in some examples of the methods provided herein the hyaluronan-degrading enzyme is modified by conjugation to a polymer. For example, the hyaluronan-degrading enzyme is conjugated to a PEG, thus the hyaluronan degrading enzyme is PEGylated. In an exemplary example, the hyaluronan-degrading enzyme is a PEGylated PH20 enzyme (PEGPH20). In the methods provided herein, the corticosteroid can be a glucocorticoid that is selected from among cortisones, dexamethasones, hydrocortisones, methylprednisolones, prednisolones and prednisones.

Also provided herein is a kit containing a hyaluronan binding agent (HABP) for detecting the amount of hyaluronan in a sample, wherein the HABP has not been prepared from animal cartilage and a hyaluronan-degrading enzyme. The HABP can be generated recombinantly or synthetically. In some examples, the HABP contains one link module. In other examples, the HABP contains two or more link modules. In some examples, the link module or modules are the only HABP portion of the molecule. For example, the HABP contains a link module selected from among CD44, LYVE-1, HAPLN1/link protein, HAPLN2, HAPLN3, HAPLN4, aggrecan, versican, neurocan, brevican, phosphacan, TSG-6, Stabilin-1, Stabilin-2, CAB61358 and KIA0527 or a portion thereof comprising a link module or a sufficient portion of a link module to bind HA. In other examples, the HABP contains a G1 domain of a type C hyaluronan binding protein, for example, a G1 domain selected from among Aggrecan G1, Versican G1, Neurocan G1 and Brevican G1. In particular examples, the G1 domain is the only HABP portion of the molecule.

In some examples, the kit contains an HABP containing the sequence of amino acids set forth in any of SEQ ID NOS: 207, 222, 360, 361, 371-394 and 416-418, and 423-426 or a sequence of amino acids that exhibits at least 65%, 70%, 75%, 80%, 85%, 90%, 91%, 92%, 93%, 95%, 95%, 96%, 97%, 98%, 99% or more sequence identity to a sequence of amino acids set forth in any of SEQ ID NOS: 207, 222, 360, 361, 371-394, 416-418 and 423-426 and specifically binds HA, or an HA-binding domain thereof or a sufficient portion thereof to specifically bind to HA. In an exemplary example, the HABP contains a TSG-6 link module (LM) or a sufficient portion thereof that specifically binds HA. For example, the TSG-6-LM contains the sequence of amino acids set forth in SEQ ID NO: 207, 360, 417 or 418, or a sequence of amino acids comprising at least 65% amino acid sequence identity to the sequence of amino acids set forth in SEQ ID NO: 207, 360, 417 or 418 and specifically binds HA. In some examples, the HABP contains a link module that exhibits at least 70%, 75%, 80%, 85%, 90%, 91%, 92%, 93%, 94%, 95%, 96%, 97%, 98%, or 99% sequence identity to the sequence of amino acids set forth in SEQ ID NO:360, whereby the HABP binds HA. In particular examples, the HABP contains a link module set forth in SEQ ID NO: 207, 360, 417 or 418.

In some examples of the kits provided herein, the TSG-6 link module is modified to reduce or eliminate binding to heparin. For example, binding to heparin is reduced at least 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold or more. In some examples, TSG-6 link module contains an amino acid replacement at an amino acid position corresponding to amino acid residue 20, 34, 41, 54, 56, 72 or 84 set forth in SEQ ID NO:360, whereby a corresponding amino acid residue is identified by alignment to a TSG-6-LM set forth in SEQ ID NO:360. For example, the amino acid replacement is to a non-basic amino acid residue selected from among Asp (D), Glu (E), Ser (S), Thr (T), Asn (N), Gln (Q), Ala (A), Val (V), Ile (I), Leu (L), Met (M), Phe (F), Tyr (Y) and Trp (W). Thus, provided herein is a kit wherein the TSG-6 link module contains an amino acid replacement corresponding to amino acid replacement K20A, K34A or K41A in a TSG-6-LM set forth in SEQ ID NO:360 or the replacement at the corresponding residue in another TSG-6-LM. For example, the TSG-6 link module contains amino acid replacements corresponding to amino acid replacements K20A, K34A and K41A in a TSG-6-LM set forth in SEQ ID NO:360 or the replacement at the corresponding residue in another TSG-6-LM. Also provided herein, are kits wherein the HABP contains a link module set forth in SEQ ID NO:361 or 416 or a sequence of amino acids comprising at least 65% amino acid sequence identity to the sequence of amino acids set forth in SEQ ID NO:361 or 416 that specifically binds HA. For example, the HABP contains a link module that exhibits at least 70%, 75%, 80%, 85%, 90%, 91%, 92%, 93%, 94%, 95%, 96%, 97%, 98%, or 99% sequence identity to the sequence of amino acids set forth in SEQ ID NO:361 or 416, whereby the HABP specifically binds HA. In particular examples, the HABP contains a link module set forth in SEQ ID NO:361 or 416. In other examples, the link module is the only TSG-6 portion of the HABP.

In some examples of the kits provided herein, the HABP is a multimer containing a first HA-binding domain linked directly or indirectly via a linker to a multimerization domain and a second HA-binding domain linked directly or indirectly via a linker to a multimerization domain. For example, the HA-binding domain is a link module or a G1 domain. The first and second HA-binding domain can be the same or different.

In a particular example, the first and second HA-binding domain is a TSG-6 link module, a variant thereof or a sufficient portion thereof that specifically binds to HA. For example, the TSG-6-LM contains a sequence of amino acids set forth in SEQ ID NO: 207, 360, 361, 416, 417 or 418 or a sequence of amino acids comprising at least 65% amino acid sequence identity to the sequence of amino acids set forth in SEQ ID NO: 207, 360, 361, 416, 417 or 418 that specifically binds HA. For example, the link module exhibits at least 70%, 75%, 80%, 85%, 90%, 91%, 92%, 93%, 94%, 95%, 96%, 97%, 98%, or 99% sequence identity to the sequence of amino acids set forth in SEQ ID NO: 207, 360, 361, 416, 417 or 418, whereby the HABP specifically binds HA. In some methods provided herein, the link module contains a sequence of amino acids set forth in SEQ ID NO: 207, 360, 361, 416, 417 or 418.

In the provided kits, the HABPs can be linked by a multimerization domain that is selected from among an immunoglobulin constant region (Fc), a leucine zipper, complementary hydrophobic regions, complementary hydrophilic regions, compatible protein-protein interaction domains, free thiols that forms an intermolecular disulfide bond between two molecules, and a protuberance-into-cavity and a compensatory cavity of identical or similar size that form stable multimers. In a particular example, the multimerization domain is an Fc domain or a variant thereof that effects multimerization. For example, the Fc domain is from an IgG, IgM or an IgE, or the Fc domain has a sequence of amino acids set forth in SEQ ID NO:359. In some instances of the methods provided herein, the HABP is a fusion protein that contains a TSG-6 link module and an immunoglobulin Fc domain. For example, the HABP is TSG-6-LM-Fc that has a sequence of amino acids set forth in SEQ ID NO:212 or 215 or a sequence of amino acids that exhibits at least 65% amino acid sequence identity to SEQ ID NO:212 or 215 and specifically binds HA, such as a sequence of amino acids that exhibits at least 70%, 75%, 80%, 85%, 90%, 91%, 92%, 93%, 94%, 95%, 96%, 97%, 98%, or 99% sequence identity to the sequence of amino acids set forth in SEQ ID NO:212 or 215, whereby the HABP specifically binds HA. In particular examples, the HABP has a sequence of amino acids set forth in SEQ ID NO:212 or 215. In any of the methods provided herein the, HABP can be TSG-6-LM-Fc/ΔHep that has a sequence of amino acids set forth in SEQ ID NO: 215 or a sequence of amino acids that exhibits at least 65% amino acid sequence identity to SEQ ID NO:215 and specifically binds HA, such as a sequence of amino acids that exhibits at least 70%, 75%, 80%, 85%, 90%, 91%, 92%, 93%, 94%, 95%, 96%, 97%, 98%, or 99% sequence identity to the sequence of amino acids set forth in SEQ ID NO:215, whereby the HABP specifically binds HA.

In particular examples of kits provided herein, the HABP is a TSG-6 or hyaluronan-binding region thereof. In some examples of the methods provided herein, the HABP has a binding affinity, represented by the association constant (Ka), to HA of at least $10^7$ M$^{-1}$, for example, at least $1\times10^8$ M$^{-1}$, $2\times10^8$ M$^{-1}$, $3\times10^8$ M$^{-1}$, $4\times10^8$ M$^{-1}$, $5\times10^8$ M$^{-1}$, $6\times10^8$ M$^{-1}$, $7\times10^8$ M$^{-1}$, $8\times10^8$ M$^{-1}$, $9\times10^8$ M$^{-1}$, $1\times10^9$ M$^{-1}$ or higher. For example, the HABP has a binding affinity, represented by the dissociation constant (Kd), to HA of at least less than or less than $1\times10^{-7}$ M, $9\times10^{-8}$ M, $8\times10^{-8}$ M, $7\times10^{-8}$ M, $6\times10^{-8}$ M, $5\times10^{-8}$ M, $4\times10^{-8}$ M, $3\times10^{-8}$ M, $2\times10^{-8}$ M, $1\times10^{-8}$ M, $9\times10^{-9}$ M, $8\times10^{-9}$ M, $7\times10^{-9}$ M, $6\times10^{-9}$ M, $5\times10^{-9}$ M, $4\times10^{-9}$ M, $3\times10^{-9}$ M, $2\times10^{-9}$ M, $1\times10^{-9}$ M or lower Kd. In other examples, the HABP is conjugated to a detectable moiety that is detectably labeled or that can be detected. For example, the HABP is biotinylated.

Also provided herein are kits containing a hyaluronan binding agent (HABP) for detecting the amount of hyaluronan in a sample, wherein the HABP has not been prepared from animal cartilage and an anti-hyaluronan agent (e.g., a hyaluronan-degrading enzyme). Any of the kits provided herein can further contain reagents for detection of the HABP. In any example of the kits provided herein, the anti-hyaluronan agent can be any described above or elsewhere herein. For example, the anti-hyaluronan agent can be a hyaluronan degrading enzyme such as a hyaluronidase. For example, the hyaluronan-degrading enzyme is a PH20 hyaluronidase or truncated form thereof lacking a C-terminal glycosylphosphatidylinositol (GPI) attachment site or a portion of the GPI attachment site. In some examples, the PH20 is selected from a human, monkey, bovine, ovine, rat, mouse or guinea pig PH20. For example, the hyaluronan-degrading enzyme is a human PH20 hyaluronidase that is neutral active and N-glycosylated and is selected from among (a) a hyaluronidase polypeptide that is a full-length PH20 or is a C-terminal truncated form of the PH20, wherein the truncated form includes at least amino acid residues 36-464 of SEQ ID NO:1, wherein the full-length PH20 comprises the sequence of amino acids set forth in SEQ ID NO:2; or (b) a hyaluronidase polypeptide comprising a sequence of amino acids having at least 85%, 86%, 87%, 88%, 89%, 90%, 91%, 92%, 93%, 94%, 95%, 96%, 97%, 98%, 99% or more sequence identity with the polypeptide or truncated form of sequence of amino acids set forth in SEQ ID NO:2; or (c) a hyaluronidase polypeptide of (a) or (b) comprising amino acid substitutions, whereby the hyaluronidase polypeptide has a sequence of amino acids having at least 85%, 86%, 87%, 88%, 89%, 90%, 91%, 92%, 93%, 94%, 95%, 96%, 97%, 98%, 99% or more sequence identity with the polypeptide set forth in SEQ ID NO:2 or the with the corresponding truncated forms thereof. In particular examples, the hyaluronan-degrading enzyme is a PH20 that comprises a composition designated rHuPH20. In some examples, the hyaluronan-degrading enzyme is modified by conjugation to a polymer, such as, for example, a PEG, and the hyaluronan degrading enzyme is PEGylated. Therefore provided herein is a kit wherein the hyaluronan-degrading enzyme is a PEGylated PH20 enzyme (PEGPH20). Also provided herein are kits that further contain a corticosteroid. Any of the kits provided herein can further contain a label or package insert for use of its components.

Provided herein are methods of use of a hyaluronan binding protein (HABP) for selecting a subject for treatment of a tumor with an anti-hyaluronan agent (e.g. a hyaluronan-degrading enzyme), wherein the HABP has not been prepared or isolated from animal cartilage. Also provided herein are pharmaceutical compositions containing a hyaluronan binding protein (HABP) for use in selecting a subject for treatment of a tumor with an anti-hyaluronan agent (e.g. a hyaluronan-degrading enzyme), wherein the HABP has not been prepared or isolated from animal cartilage.

Provided herein are methods of use of a hyaluronan binding protein (HABP) for predicting efficacy of treatment of a subject with an anti-hyaluronan agent (e.g. a hyaluronan-degrading enzyme), wherein the HABP has not been prepared or isolated from animal cartilage. Also provided herein are pharmaceutical compositions containing a hyaluronan binding protein (HABP) for predicting efficacy of treatment of a subject with an anti-hyaluronan agent (e.g. a hyaluronan-degrading enzyme), wherein the HABP has not been prepared or isolated from animal cartilage.

In any of the uses or pharmaceutical compositions provided herein, the HABP can contain a link module or modules or a G1 domain. In some examples, the HABP contains a TSG-6 link module (LM), a variant thereof or a sufficient portion thereof that binds HA. In a particular example, the TSG-6 link module is modified to reduce or eliminate binding to heparin. In some examples, the HABP contains a sequence of amino acids set forth in any of SEQ ID NOS: 207, 212, 215, 222, 360, 361, 371-394 and 416-418, and 423-426 or a sequence of amino acids that exhibits at least 65%, 70%, 75%, 80%, 85%, 90%, 91%, 92%, 93%, 95%, 95%, 96%, 97%, 98%, 99% or more sequence identity to a sequence of amino acids set forth in any of SEQ ID NOS: 207, 212, 215, 222, 360, 361, 371-394 and 416-418, and 423-426 and specifically binds HA, or an HA-binding domain thereof or a sufficient portion thereof to specifically bind to HA.

Also provided herein is a TSG-6-LM multimer containing a first link module linked directly or indirectly via a linker to a multimerization domain and a second link module linked directly or indirectly via a linker to a multimerization domain, wherein the first and second polypeptide do not comprise the full-length sequence of TSG-6. In some examples, the link module is the only TSG-6 portion of the first polypeptide and the second polypeptide. The first and second link module can be the same or different. In some examples, the link module contains a sequence of amino acids set forth in SEQ ID NO: 207, 360, 417 or 418 or a sequence of amino acids comprising at least 65% amino acid sequence identity to the sequence of amino acids set forth in SEQ ID NO: 207, 360, 417 or 418 that specifically binds HA. For example, the link module exhibits at least 70%, 75%, 80%, 85%, 90%, 91%, 92%, 93%, 94%, 95%, 96%, 97%, 98%, or 99% sequence identity to the sequence of amino acids set forth in SEQ ID NO: 207, 360, 417 or 418 that specifically binds HA. In some examples, the link module contains a sequence of amino acids set forth in SEQ ID NO: 207, 360, 417 or 418.

In some examples, the TSG-6 link module is modified to reduce or eliminate binding to heparin. Binding to heparin can be reduced at least 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold or more. In some examples, the TSG-6 link module contains an amino acid replacement at an amino acid position corresponding to amino acid residue 20, 34, 41, 54, 56, 72 or 84 set forth in SEQ ID NO:360, whereby a corresponding amino acid residue is identified by alignment to a TSG-6-LM set forth in SEQ ID NO:360. For example, the amino acid replacement is in a TSG-6-LM set forth in SEQ ID NO:207 and the amino acid replacement or replacements is at amino acid residue 21, 35, 42, 55, 57, 73 or 85. In some examples, the amino acid replacement is to a non-basic amino acid residue selected from among Asp (D), Glu (E), Ser (S), Thr (T), Asn (N), Gln (Q), Ala (A), Val (V), Ile (I), Leu (L), Met (M), Phe (F), Tyr (Y) and Trp (W). For example, the TSG-6 link module contains an amino acid replacement corresponding to amino acid replacement K20A, K34A or K41A in a TSG-6-LM set forth in SEQ ID NO:360 or the replacement at the corresponding residue in another TSG-6-LM. In a particular example, the TSG-6 link module contains amino acid replacements corresponding to amino acid replacements K20A, K34A and K41A in a TSG-6-LM set forth in SEQ ID NO:360 or the replacement at the corresponding residue in another TSG-6-LM. In some examples, the link module contains a sequence of amino acids set forth in SEQ ID NO: 361 or 416 or a sequence of amino acids comprising at least 65% amino acid sequence identity to the sequence of amino acids set forth in SEQ ID NO: 361 or 416 that specifically binds HA. For example, the link module exhibits at least 70%, 75%, 80%, 85%, 90%, 91%, 92%, 93%, 94%, 95%, 96%, 97%, 98%, or 99% sequence identity to the sequence of amino acids set forth in SEQ ID NO: 361 or 416 and specifically binds HA. In particular examples, the link module contains a sequence of amino acids set forth in SEQ ID NO: 361 or 416.

Also provided herein is a TSG-6-LM multimer wherein the multimerization domain is selected from among an immunoglobulin constant region (Fc), a leucine zipper, complementary hydrophobic regions, complementary hydrophilic regions, compatible protein-protein interaction domains, free thiols that forms an intermolecular disulfide bond between two molecules, and a protuberance-into-cavity and a compensatory cavity of identical or similar size that form stable multimers. In some examples, the multimerization domain is an Fc domain or a variant thereof that effects multimerization. For example, the Fc domain is from an IgG, IgM or an IgE. In a particular example, the Fc domain has a sequence of amino acids set forth in SEQ ID NO:359.

Also provided herein is a TSG-6-LM multimer containing a TSG-6 link module and an immunoglobulin Fc domain. In some examples, the TSG-6-LM multimer contains a sequence of amino acids set forth in SEQ ID NO: 212 or 215 or a sequence of amino acids that exhibits at least 65% amino acid sequence identity to SEQ ID NO:212 or 215. For example, the TSG-6 multimer contains a sequence of amino acids that exhibits at least 70%, 75%, 80%, 85%, 90%, 91%, 92%, 93%, 94%, 95%, 96%, 97%, 98%, or 99% sequence identity to the sequence of amino acids set forth in SEQ ID NO:212 or 215 and that specifically binds HA. In particular examples, the TSG-6-LM multimer contains a sequence of amino acids set forth in SEQ ID NO:212 or 215. In some examples, the TSG-6-LM multimer has a binding affinity to HA of at least $10^7$ $M^{-1}$, for example at least $1 \times 10^8$ $M^{-1}$, $2 \times 10^8$ $M^{-1}$, $3 \times 10^8$ $M^{-1}$, $4 \times 10^8$ $M^{-1}$, $5 \times 10^8$ $M^{-1}$, $6 \times 10^8$ $M^{-1}$, $7 \times 10^8$ $M^{-1}$, $8 \times 10^8$ $M^{-1}$, $9 \times 10^8$ $M^{-1}$, $1 \times 10^9$ $M^{-1}$ or lower.

Also provided herein are methods of selecting a subject, predicting efficacy and/or monitoring treatment using any of the above provided HABP to detect HA by in vivo imaging methods. The in vivo imaging method can be magnetic resonance imaging (MRI), single-photon emission computed tomography (SPECT), computed tomography (CT), computed axial tomography (CAT), electron beam computed tomography (EBCT), high resolution computed tomography (HRCT), hypocycloidal tomography, positron emission tomography (PET), scintigraphy, gamma camera, a β+ detector, a γ detector, fluorescence imaging, low-light imaging, X-rays, and/or bioluminescence imaging. In such methods, the HABP is conjugated, directly or indirectly, to a moiety that provides a signal or induces a signal that is detectable in vivo.

DETAILED DESCRIPTION
Outline

A. DEFINITIONS
B. HYALURONAN BINDING PROTEIN AND COMPANION DIAGNOSTIC
  1. Hyaluronan Accumulation in Disease And Correlation to Prognosis
  2. Therapy of Tumors with An Anti-Hyaluronan Agent (e.g. Hyaluronan-Degrading Enzyme) and Responsiveness to Treatment
  3. Hyaluronan Binding Proteins (HABPs) Reagent and Diagnostic
  4. Companion Diagnostic and Prognostic Methods
C. HYALURONAN BINDING PROTEINS (HABPs) FOR USE AS A COMPANION DIAGNOSTIC
  1. HA Binding Proteins with Link Modules or G1 domains
    a. Type A: TSG-6 sub-group
      i. TSG-6
      ii. Stabilin-1 and Stabilin-2

DETAILED DESCRIPTION
Outline b. Type B: CD44 sub-group
   i. CD44
   ii. LYVE-1
  c. Type C: Link Protein sub-group
   i. HAPLN/Link Protein family
    (1) HAPLN1
    (2) HAPLN2
    (3) HAPLN3
    (4) HAPLN4
    (5) Aggrecan
    (6) Brevican
    (7) Versican
    (8) Neurocan
    (9) Phosphacan
 2. HA Binding Proteins Without Link Modules
  a. HABP1/C1QBP
  b. Layilin
  c. RHAMM
  d. Others
 3. Modifications of HA Binding Proteins
  a. Multimers of HABP
   i. Peptide Linkers
   ii. Heterobifunctional linking agents
   iii. Polypeptide Multimerization domains
    (1) Immunoglobulin domain
     (a) Fc domain
    (2) Leucine Zipper
    (3) Protein-Protein Interaction between Subunits
   iv. Other multimerization domains
  b. Mutations to Improve HA Binding
  c. Modifications of HA Binding Proteins for Detection
   i. Conjugation to Detectable Proteins or Moieties
 4. Selection of HA Binding Proteins for Diagnostic Use
D. ASSAYS AND CLASSIFICATION
 1. Assays for Measuring Hyaluronan
  a. Histochemical and Immunohistochemical Methods
  b. Solid Phase Binding Assays
  c. In vivo Imaging Assays
 2. Classification of Subjects
E. TREATMENT OF SELECTED SUBJECT WITH AN ANTI-HYALURONAN AGENT
 1. Anti-Hyaluronan Agent
  a. Agents that Inhibit Hyaluronan Synthesis
  b. Hyaluronan-degrading Enzymes
   i. Hyaluronidases
    (1) Mammalian-type hyaluronidases
     (a) PH20
    (2) Other hyaluronidases
    (3) Other hyaluronan degrading enzymes
   ii. Soluble hyaluronan-degrading enzymes
    (1) Soluble Human PH20
    (2) rHuPH20
   iii. Glycosylation of hyaluronan-degrading enzymes
   iv. Modified (Polymer-Conjugated) hyaluronan degrading enzymes
 2. Pharmaceutical Compositions and Formulations
 3. Dosages and Administration
  a. Administration of a PEGylated hyaluronan-degrading enzyme
 4. Combination Treatments
F. METHODS OF PRODUCING NUCLEIC ACIDS AND ENCODED POLYPEPTIDES OF HYALURONAN-DEGRADING ENZYMES AND HYALURONAN BINDING PROTEINS
 1. Vectors and Cells
 2. Expression
  a. Prokaryotic Cells
  b. Yeast Cells
  c. Insect Cells
  d. Mammalian Cells
  e. Plants
 3. Purification Techniques
 4. PEGylation of Hyaluronan-degrading Enzyme Polypeptides
G. METHODS OF ASSESSING ACTIVITY AND MONITORING EFFECTS OF ANTI-HYALURONAN AGENTS
 1. Methods to Assess Side Effects
 2. Evaluating Biomarkers Associated With Activity of an Anti-Hyaluronan Agent (e.g. Hyaluronan-Degrading Enzyme Activity)
  a. Assays to assess the activity of a Hyaluronan Degrading Enzyme
  b. Measurement of HA catabolites
  c. Tumor metabolic activity
  d. Increased apparent diffusion and enhanced tumor perfusion
 3. Tumor Size and Volume
 4. Pharmacokinetic and Pharmacodynamic Assays
H. KITS AND ARTICLES OF MANUFACTURE
I. EXAMPLES

A. DEFINITIONS

Unless defined otherwise, all technical and scientific terms used herein have the same meaning as is commonly understood by one of skill in the art to which the invention(s) belong. All patents, patent applications, published applications and publications, GENBANK sequences, websites and other published materials referred to throughout the entire disclosure herein, unless noted otherwise, are incorporated by reference in their entirety. In the event that there is a plurality of definitions for terms herein, those in this section prevail. Where reference is made to a URL or other such identifier or address, it is understood that such identifiers can change and particular information on the internet can come and go, but equivalent information is known and can be readily accessed, such as by searching the internet and/or appropriate databases. Reference thereto evidences the availability and public dissemination of such information.

As used herein, a companion diagnostic refers to a diagnostic method and or reagent that is used to identify subjects susceptible to treatment with a particular treatment or to monitor treatment and/or to identify an effective dosage for a subject or sub-group or other group of subjects. For purposes herein, a companion diagnostic refers to reagents, such as modified TSG-6 proteins, that are used to detect hyaluronan in a sample. The companion diagnostic refers to the reagents and also to the test(s) that is/are performed with the reagent.

As used herein, hyaluronan (HA; also known as hyaluronic acid or hyaluronate) refers to a naturally occurring polymer of repeated disaccharide units of N-acetylglucosamine and D-glucuronic acid. Hyaluronan is produced by certain tumors.

As used herein, "high HA" with reference to the amount or level of HA in a tissue or body fluid sample refers to the degree or extent of HA in the tissue or body fluid sample as compared to a normal or healthy tissue or body fluid sample. The amount of HA is high if the amount is at least or at least about 2.5-fold, 3-fold, 4-fold, 5-fold, 6-fold, 7-fold, 8-fold, 9-fold, 10-fold, 20-fold, 30-fold, 40-fold, 50-fold, 60-fold, 70-fold or higher than the amount or level of HA in a corresponding normal or healthy tissue. It is understood that the amount of HA can be determined and quantitated or semi-quantitated using methods such as solid-phase binding assays or histochemistry. For example, the amount can be based on comparison of plasma levels or comparison of staining intensity (e.g. percent positive pixels) as determined by histochemistry. For example, high HA exists if the HA score by histochemistry or other method is HA$^{+3}$ and/or if there is HA staining over 25% of tumor section. For example, high HA exists if there is a ratio of strong positive stain (such as brown stain) to the sum of total stained area that is more than 25% strong positive stain to total stain the tumor tissue.

As used herein, an HA score refers to a semi-quantitative score of HA positivity levels on cell members and stroma of tumors. The score can be determined by detection of HA in tumor tissue, such as formalin-fixed and paraffin-embedded tissue, by histochemistry methods, such as immunohistochemistry or pseudo immunohistochemistry methods, for HA using an HABP. The degree of stain on cells and stroma can be determined visually under a microscope or by available computer algorithm programs and software. For example, images can be quantitatively analyzed using a pixel count algorithm for HA stain (e.g. Aperio Spectrum Software and other standard methods that measure or quantitate or semi-quantitate the degree of staining). A tumor is graded or scored as $HA^{High}$ ($HA^{+3}$) at strong HA staining over 25% of tumor section; as $HA^{Moderate}$ ($HA^{+2}$) at strong HA staining between 10 and 25% of tumor section; and as $HA^{Low}$ $HA^{+1}$) at strong HA staining under 10% of tumor section. For example, a ratio of strong positive stain (such as brown stain) to the sum of total stained area can be calculated and scored, where if the ratio is more than 25% strong positive stain to total stain the tumor tissue is scored as $HA^{+3}$, if the ratio is 10-25% of strong positive stain to total stain the tumor tissue is scored as $HA^{+2}$, if the ratio is less than 10% of strong positive stain to total stain the tumor tissue is scored as $HA^{+1}$, and if the ratio of strong positive stain to total stain is 0 the tumor tissue is scored as 0. The Aperio method, as well as software therefor, are known to those of skill in the art (see, e.g., U.S. Pat. No. 8,023,714; U.S. Pat. No. 7,257,268).

As used herein, a hyaluronan binding protein (HA binding protein; HABP) or hyaladherin refers to any protein that specifically binds to HA to permit detection of the HA. The binding affinity is one that has as an association constant Ka that is at least about or is at least $10^7 M^{-1}$. For the methods and companion diagnostic products provided herein, the HA binding protein is a recombinantly produced or synthetic protein(s), not a protein derived from a biological source or physiologic source, such as cartilage. HA binding proteins include HA binding domains, including link modules that bind to HA and sufficient portions thereof that specifically binds to HA to permit detection thereof. Hence, HABPs include any protein that contains a hyaluronan binding region or domain or a sufficient portion thereof to specifically bind HA. Exemplary hyaluronan binding regions are link modules (link domains) or G1 domains. A sufficient portion includes at least 10, 20, 30, 40, 50, 60, 70, 80, 90, 95 or more contiguous amino acids of a binding domain or link module. HA binding proteins also include fusion proteins containing an HA binding protein and one or more additional polypeptides, including multimerization domains. Exemplary HA binding proteins include, but are not limited to, aggrecan, versican, neurocan, brevican, phosphacan, TSG-6, TSG-6 mutants, such as those provided herein, including polypeptides containing HA binding domains and link modules thereof that bind to HA.

As used herein, hyaluronan-binding domain or HA-binding domain refers to a region or domain of an HABP polypeptide that specifically binds to hyaluronan with a binding affinity that has as an association constant Ka that is at least about or is at least $10^6 M^{-1}$ or $10^7 M^{-1}$ or greater or a dissociation constant Kd that is less than $10^{-6}$ M or $10^{-7}$ M or less. Exemplary hyaluronan-binding domains include, for example, link modules (also called link domains herein) or G1 domains, or sufficient portions of a link module or G1 domain that specifically binds to HA.

As used herein, reference that "the only portion of an HABP" is a link module or G1 domain or grammatical variations thereof means that the HABP molecule (e.g. a TSG-6 link module) consists or consists essentially of the link module or G1 domain but does not include the complete full-length sequence of amino acids of the reference HABP. Hence, the HABP only contains a hyaluronan-binding region or a sufficient portion thereof to specifically bind to HA. It is understood that the HABP can contain additional non-HABP amino acid sequences, including but not limited to, sequences that correspond to a detectable moiety or moiety capable of detection or a multimerization domain.

As used herein, modified, with respect to modified HA binding proteins refers to modifications to alter, typically improve, one more properties of an HA binding protein for detection in the diagnostic methods provided herein. Modifications include mutations that increase affinity and/or specificity of the protein for HA.

As used herein, a domain refers to a portion (a sequence of three or more, generally 5 or 7 or more amino acids) of a polypeptide that is a structurally and/or functionally distinguishable or definable. For example, a domain includes those that can form an independently folded structure within a protein made up of one or more structural motifs (e.g. combinations of alpha helices and/or beta strands connected by loop regions) and/or that is recognized by virtue of a functional activity, such as kinase activity. A protein can have one, or more than one, distinct domain. For example, a domain can be identified, defined or distinguished by homology of the sequence therein to related family members, such as homology and motifs that define an extracellular domain. In another example, a domain can be distinguished by its function, such as by enzymatic activity, e.g. kinase activity, or an ability to interact with a biomolecule, such as DNA binding, ligand binding, and dimerization. A domain independently can exhibit a function or activity such that the domain independently or fused to another molecule can perform an activity, such as, for example proteolytic activity or ligand binding. A domain can be a linear sequence of amino acids or a non-linear sequence of amino acids from the polypeptide. Many polypeptides contain a plurality of domains.

As used herein, a fusion protein refers to a chimeric protein containing two or more portions from two more proteins or peptides that are linked directly or indirectly via peptide bonds.

As used herein, a multimerization domain refers to a sequence of amino acids that promotes stable interaction of a polypeptide molecule with another polypeptide molecule containing a complementary multimerization domain, which can be the same or a different multimerization domain to form a stable multimer with the first domains. Generally, a polypeptide is joined directly or indirectly to the multimerization domain. Exemplary multimerization domains include the immunoglobulin sequences or portions thereof, leucine zippers, hydrophobic regions, hydrophilic regions, compatible protein-protein interaction domains such as, but not limited to an R subunit of PKA and an anchoring domain (AD), a free thiol that forms an intermolecular disulfide bond between two molecules, and a protuberance-into-cavity (i.e., knob into hole) and a compensatory cavity of identical or similar size that form stable multimers. The multimerization domain, for example, can be an immunoglobulin constant region. The immunoglobulin sequence can be an immunoglobulin constant domain, such as the Fc domain or portions thereof from IgG1, IgG2, IgG3 or IgG4 subtypes, IgA, IgE, IgD and IgM.

As used herein, "knobs into holes" (also referred to herein as protuberance-into-cavity) refers to particular multimerization domains engineered such that steric interactions between and/or among such domains, not only promote stable interaction, but also promote the formation of heterodimers (or multimers) over homodimers (or homomultimers) from a mixture of monomers. This can be achieved, for example by constructing protuberances and cavities. Protuberances can be constructed by replacing small amino acid side chains from the interface of the first polypeptide with larger side chains (e.g. tyrosine or tryptophan). Compensatory "cavities" of identical or similar size to the protuberances optionally are created on the interface of a second polypeptide by replacing large amino acid side chains with smaller ones (e.g., alanine or threonine).

As used herein, complementary multimerization domains refer to two or more multimerization domains that interact to form stable multimers of polypeptides linked to each such domain. Complementary multimerization domains can be the same domain or a member of a family of domains, such as for example, Fc regions, leucine zippers, and knobs and holes.

As used herein, "Fc" or "Fc region" or "Fc domain" refers to a polypeptide containing the constant region of an antibody heavy chain, excluding the first constant region immunoglobulin domain. Thus, Fc refers to the last two constant region immunoglobulin domains of IgA, IgD, and IgE, or the last three constant region immunoglobulin domains of IgE and IgM. Optionally, an Fc domain can include all or part of the flexible hinge N-terminal to these domains. For IgA and IgM, Fc can include the J chain. For an exemplary Fc domain of IgG contains immunoglobulin domains Cγ2 and Cγ3, and optionally all or part of the hinge between Cγ1 and Cγ2. The boundaries of the Fc region can vary, but typically, include at least part of the hinge region. In addition, Fc also includes any allelic or species variant or any variant or modified form, such as any variant or modified form that alters the binding to an FcR or alters an Fc-mediated effector function. Exemplary sequences of other Fc domains, including modified Fc domains are known.

As used herein, "Fc chimera" refers to a chimeric polypeptide in which one or more polypeptides is linked, directly or indirectly, to an Fc region or a derivative thereof. Typically, an Fc chimera combines the Fc region of an immunoglobulin with another polypeptide, such as for example an ECD polypeptide. Derivatives of or modified Fc polypeptides are known to those of skill in the art.

As used herein, "multimer" with reference to a hyaluronan binding protein refers to an HABP that contains multiple HA binding sites, for example, at least 2, 3, or 4 HA binding sites. For example, an HABP multimer refers to a HABP that contains at least 2 link modules that are each capable of binding to HA. For example, a multimer can be generated by linking, directly or indirectly, two or more link modules (e.g. TSG-6 link module). The linkage can be facilitated using a multimerization domain, such as an Fc protein.

As used herein, an allelic variant or allelic variation references to a polypeptide encoded by a gene that differs from a reference form of a gene (i.e. is encoded by an allele). Typically the reference form of the gene encodes a wildtype form and/or predominant form of a polypeptide from a population or single reference member of a species. Typically, allelic variants, which include variants between and among species typically have at least 80%, 90% or greater amino acid identity with a wildtype and/or predominant form from the same species; the degree of identity depends upon the gene and whether comparison is interspecies or intraspecies. Generally, intraspecies allelic variants have at least about 80%, 85%, 90% or 95% identity or greater with a wildtype and/or predominant form, including 96%, 97%, 98%, 99% or greater identity with a wildtype and/or predominant form of a polypeptide.

As used herein, species variants refer to variants of the same polypeptide between and among species. Generally, interspecies variants have at least about 60%, 70%, 80%, 85%, 90%, or 95% identity or greater with a wildtype and/or predominant form from another species, including 96%, 97%, 98%, 99% or greater identity with a wildtype and/or predominant form of a polypeptide.

As used herein, modification in reference to modification of a sequence of amino acids of a polypeptide or a sequence of nucleotides in a nucleic acid molecule and includes deletions, insertions, and replacements of amino acids and nucleotides, respectively.

As used herein, a composition refers to any mixture. It can be a solution, a suspension, liquid, powder, a paste, aqueous, non-aqueous or any combination thereof.

As used herein, a combination refers to any association between or among two or more items. The combination can be two or more separate items, such as two compositions or two collections, can be a mixture thereof, such as a single mixture of the two or more items, or any variation thereof. The elements of a combination are generally functionally associated or related. A kit is a packaged combination that optionally includes instructions for use of the combination or elements thereof.

As used herein, normal levels or values can be defined in a variety of ways known to one of skill in the art. Typically, normal levels refer to the expression levels of a HA across a healthy population. The normal levels (or reference levels) are based on measurements of healthy subjects, such as from a specified source (i.e. blood, serum, tissue, or other source). Often, a normal level will be specified as a "normal range", which typically refers to the range of values of the median 95% of the healthy population. Reference value is used interchangeably herein with normal level but can be different from normal levels depending on the subjects or the source. Reference levels are typically dependent on the normal levels of a particular segment of the population. Thus, for purposes herein, a normal or reference level is a predetermined standard or control by which a test patient can be compared.

As used herein, elevated level refers to the any level of amount or expression of HA above a recited or normal threshold.

As used herein, biological sample refers to any sample obtained from a living or viral source or other source of macromolecules and biomolecules, and includes any cell type or tissue of a subject from which nucleic acid or protein or other macromolecule can be obtained. The biological sample can be a sample obtained directly from a biological source or to sample that is processed. For example, isolated nucleic acids that are amplified constitute a biological sample. Biological samples include, but are not limited to, body fluids, such as blood, plasma, serum, cerebrospinal fluid, synovial fluid, urine and sweat, tissue and organ samples from animals, including biopsied tumor samples.

As used herein, detection includes methods that permit visualization (by eye or equipment) of a protein. A protein can be visualized using an antibody specific to the protein. Detection of a protein can also be facilitated by fusion of a protein with a tag including an epitope tag or label.

As used herein, a label refers to a detectable compound or composition which is conjugated directly or indirectly to a polypeptide so as to generate a labeled polypeptide. The label can be detectable by itself (e.g., radioisotope labels or fluorescent labels) or, in the case of an enzymatic label, can catalyze chemical alteration of a substrate compound composition which is detectable. Non-limiting examples of labels included fluorogenic moieties, green fluorescent protein, or luciferase.

As used herein, affinity refers to the strength of interaction between two molecules such as between a hyaluronan binding protein and hyaluronan. Affinity is often measured by equilibrium association constant (Ka) or equilibrium dissociation constant (Kd). The binding affinity between the molecules described herein, typically has a binding affinity with an association constant (Ka) of at least about $10^6$ 1/mol, $10^7$ 1/mol, $10^8$ 1/mol, $10^9$ 1/mol or greater (generally $10^7$-$10^8$ 1/mol or greater). The binding affinity of molecules herein also can be described based on the dissociation constant (Kd) of at least less than or less than or $10^{-7}$ M, $10^{-8}$ M, $10^{-9}$ M, $10^{-10}$ M $10^{-11}$ M, $10^{-12}$ M or lower.

As used herein, reference to a sufficient portion thereof that binds to HA means that the binding molecule exhibits a Ka of at least or at least about $10^7$ to $10^8$ $M^{-1}$ or a dissociation constant (Kd) of $1\times10^{-7}$ M or $1\times10^{-8}$ M or less to HA.

As used herein, specificity (also referred to herein as selectively) with respect to two molecules, such as with respect to a hyaluronan binding protein and HA, refers to the greater affinity the two molecules exhibit for each other compared to affinity for other molecules. Thus, a hyaluronan binding protein (HABP) with greater specificity for HA means that it binds to other molecules, such as heparin, with lower affinity than it binds to HA. Specific binding typically results in selective binding.

As used herein, a "G1 domain" refers to an HA binding domain of a Type C HA binding protein. The G1 domain contains an Ig module and two link modules. Exemplary proteins that contain a G1 domain include HAPLN1/link protein, HAPLN1, HAPLN2, HAPLN3, HAPLN4, aggrecan, versican, brevican, neurocan and phosphacan.

As used herein, link modules or link domain, used interchangeably herein, are hyaluronan-binding domains that occur in proteins and facilitate binding to HA and that are involved in the assembly of extracellular matrix, cell adhesion and migration. For example, the link module from human TSG-6 contains two alpha helices and two antiparallel beta sheets arranged around a hydrophobic core. This defines the consensus fold for the Link module superfamily, which includes CD44, TSG-6, cartilage link protein, aggrecan and others as described herein.

As used herein, an "Ig module" refers to the portion of the G1 domain of Type C HABPs that is involved in the binding between Type C HABPs. Ig modules of Type C hyaluronans interact with one another to form a stable tertiary structure with hyaluronan.

As used herein, a "solid phase binding assay" refers to an in vitro assay in which an antigen is contacted with a ligand, where one of the antigen or ligand are bound to a solid support. The solid phase can be one in which components are physically immobilized to a solid support. For example, solid supports include, but are not limited to, a microtiter plate, a membrane (e.g., nitrocellulose), a bead, a dipstick, a thin-layer chromatographic plate, or other solid medium. Upon antigen-ligand interaction, the unwanted or non-specific components can be removed (e.g. by washing) and the antigen-ligand complex detected.

As used herein, predicting efficacy of treatment with an anti-hyaluronan agent, such as a hyaluronan-degrading enzyme, means that the companion diagnostic can be a prognostic indicator of treatment with an anti-hyaluronan agent, such as a hyaluronan degrading enzyme. For example, based on the results of detection of hyaluronan or other marker with the companion diagnostic, it can be determined that an anti-hyaluronan agent, such as a hyaluronan-degrading enzyme, will likely have some effect in treating subject.

As used herein, a prognostic indicator refers to a parameter that indicates the probability of a particular outcome, such as the probability that a treatment will be effective for a particular disease or subject.

As used herein, elevated HA in a sample refers to an amount of HA in a sample that is increased compared to the level present in a corresponding sample from a healthy sample or compared to a predetermined standard.

As used herein, elevated hyaluronan levels refers to amounts of hyaluronan in particular tissue, body fluid or cell, dependent upon the disease or condition, as a consequence of or otherwise observed in the disease. For example, as consequence of the presence of a hyaluronan-rich tumor, hyaluronan (HA) levels can be elevated in body fluids, such as blood, urine, saliva and serum, and/or in the tumorous tissue or cell. The level can be compared to a standard or other suitable control, such as a comparable sample from a subject who does not have the HA-associated disease, such as a subject that does not have a tumor.

As used herein, corresponding residues refers to residues that occur at aligned loci. Related or variant polypeptides are aligned by any method known to those of skill in the art. Such methods typically maximize matches, and include methods such as using manual alignments and by using the numerous alignment programs available (for example, BLASTP) and others known to those of skill in the art. By aligning the sequences of polypeptides, one skilled in the art can identify corresponding residues, using conserved and identical amino acid residues as guides. Corresponding positions also can be based on structural alignments, for example by using computer simulated alignments of protein structure. In other instances, corresponding regions can be identified.

As used herein, an anti-hyaluronan agent refers to any agent that modulates hyaluronan (HA) synthesis or degradation, thereby altering hyaluronan levels in a tissue or cell. For purposes herein, anti-hyaluronan agents reduce hyaluronan levels in a tissue or cell compared to the absence of the agent. Such agents include compounds that modulate the expression of genetic material encoding HA synthase (HAS) and other enzymes or receptors involved in hyaluronan metabolism, or that modulate the proteins that synthesize or degrade hyaluronan including HAS function or activity. The agents include small-molecules, nucleic acids, peptides, proteins or other compounds. For example, anti-hyaluronan agents include, but are not limited to, antisense or sense molecules, antibodies, enzymes, small molecule inhibitors and HAS substrate analogs.

As used herein, a hyaluronan-degrading enzyme refers to an enzyme that catalyzes the cleavage of a hyaluronan polymer (also referred to as hyaluronic acid or HA) into smaller molecular weight fragments. Exemplary of hyaluronan-degrading enzymes are hyaluronidases, and particular chondroitinases and lyases that have the ability to depolymerize hyaluronan. Exemplary chondroitinases that are hyaluronan-degrading enzymes include, but are not limited to, chondroitin ABC lyase (also known as chondroitinase ABC), chondroitin AC lyase (also known as chondroitin sulfate lyase or chondroitin sulfate eliminase) and chondroitin C lyase. Chondroitin ABC lyase comprises two enzymes, chondroitin-sulfate-ABC endolyase (EC 4.2.2.20) and chondroitin-sulfate-ABC exolyase (EC 4.2.2.21). An exemplary chondroitin-sulfate-ABC endolyases and chondroitin-sulfate-ABC exolyases include, but are not limited to, those from

*Proteus vulgaris* and *Pedobacter heparinus* (the *Proteus vulgaris* chondroitin-sulfate-ABC endolyase is set forth in SEQ ID NO:98; Sato et al. (1994) *Appl. Microbiol. Biotechnol.* 41(1):39-46). Exemplary chondroitinase AC enzymes from the bacteria include, but are not limited to, those from *Pedobacter heparinus*, set for th in SEQ ID NO: 99, *Victivallis vadensis*, set forth in SEQ ID NO:100, and *Arthrobacter aurescens* (Tkalec et al. (2000) *Applied and Environmental Microbiology* 66(1):29-35; Ernst et al. (1995) *Critical Reviews in Biochemistry and Molecular Biology* 30(5):387-444). Exemplary chondroitinase C enzymes from the bacteria include, but are not limited to, those from *Streptococcus* and *Flavobacterium* (Hibi et al. (1989) *FEMS-Microbiol-Lett.* 48(2):121-4; Michelacci et al. (1976) *J. Biol. Chem.* 251: 1154-8; Tsuda et al. (1999) *Eur. J. Biochem.* 262:127-133).

As used herein, hyaluronidase refers to a class of hyaluronan-degrading enzymes. Hyaluronidases include bacterial hyaluronidases (EC 4.2.2.1 or EC 4.2.99.1), hyaluronidases from leeches, other parasites, and crustaceans (EC 3.2.1.36), and mammalian-type hyaluronidases (EC 3.2.1.35). Hyaluronidases include any of non-human origin including, but not limited to, murine, canine, feline, leporine, avian, bovine, ovine, porcine, equine, piscine, ranine, bacterial, and any from leeches, other parasites, and crustaceans. Exemplary non-human hyaluronidases include, hyaluronidases from cows (SEQ ID NOS:10, 11, 64 and BH55 (U.S. Pat. Nos. 5,747,027 and 5,827,721), yellow jacket wasp (SEQ ID NOS: 12 and 13), honey bee (SEQ ID NO:14), white-face hornet (SEQ ID NO:15), paper wasp (SEQ ID NO:16), mouse (SEQ ID NOS:17-19, 32), pig (SEQ ID NOS:20-21), rat (SEQ ID NOS:22-24, 31), rabbit (SEQ ID NO:25), sheep (SEQ ID NOS:26, 27, 63 and 65), chimpanzee (SEQ ID NO:101), Rhesus monkey (SEQ ID NO:102), orangutan (SEQ ID NO:28), cynomolgus monkey (SEQ ID NO:29), guinea pig (SEQ ID NO:30), *Arthrobacter* sp. (strain FB24 (SEQ ID NO:67)), *Bdellovibrio bacteriovorus* (SEQ ID NO:68), *Propionibacterium acnes* (SEQ ID NO:69), *Streptococcus agalactiae* ((SEQ ID NO:70); 18RS21 (SEQ ID NO:71); serotype Ia (SEQ ID NO:72); serotype III (SEQ ID NO:73)), *Staphylococcus aureus* (strain COL (SEQ ID NO:74); strain MRSA252 (SEQ ID NOS:75 and 76); strain MSSA476 (SEQ ID NO:77); strain NCTC 8325 (SEQ ID NO:78); strain bovine RF122 (SEQ ID NOS:79 and 80); strain USA300 (SEQ ID NO:81)), *Streptococcus pneumoniae* ((SEQ ID NO:82); strain ATCC BAA-255/R6 (SEQ ID NO:83); serotype 2, strain D39/NCTC 7466 (SEQ ID NO:84)), *Streptococcus pyogenes* (serotype M1 (SEQ ID NO:85); serotype M2, strain MGAS10270 (SEQ ID NO:86); serotype M4, strain MGAS10750 (SEQ ID NO:87); serotype M6 (SEQ ID NO:88); serotype M12, strain MGAS2096 (SEQ ID NOS:89 and 90); serotype M12, strain MGAS9429 (SEQ ID NO:91); serotype M28 (SEQ ID NO:92)), *Streptococcus suis* (SEQ ID NOS:93-95); *Vibrio fischeri* (strain ATCC 700601/ES114 (SEQ ID NO:96)), and the *Streptomyces hyaluronolyticus* hyaluronidase enzyme, which is specific for hyaluronic acid and does not cleave chondroitin or chondroitin sulfate (Ohya, T. and Kaneko, Y. (1970) *Biochim. Biophys. Acta* 198:607). Hyaluronidases also include those of human origin. Exemplary human hyaluronidases include HYAL1 (SEQ ID NO:36), HYAL2 (SEQ ID NO:37), HYAL3 (SEQ ID NO:38), HYAL4 (SEQ ID NO:39), and PH20 (SEQ ID NO:1). Also included amongst hyaluronidases are soluble hyaluronidases, including, ovine and bovine PH20, soluble human PH20 and soluble rHuPH20. Examples of commercially available bovine or ovine soluble hyaluronidases include Vitrase® (ovine hyaluronidase), Amphadase® (bovine hyaluronidase) and Hydase™ (bovine hyaluronidase).

As used herein, "purified bovine testicular hyaluronidase" refers to a bovine hyaluronidase purified from bovine testicular extracts (see U.S. Pat. Nos. 2,488,564, 2,488,565, 2,806, 815, 2,808,362, 2,676,139, 2,795,529, 5,747,027 and 5,827, 721). Examples of commercially available purified bovine testicular hyaluronidases include Amphadase® and Hydase™, and bovine hyaluronidases, including, but not limited to, those available from Sigma Aldrich, Abnova, EMD Chemicals, GenWay Biotech, Inc., Raybiotech, Inc., and Calzyme. Also included are recombinantly produced bovine hyaluronidases, such as but not limited to, those generated by expression of a nucleic acid molecule set forth in any of SEQ ID NOS:190-192.

As used herein, "purified ovine testicular hyaluronidase" refers to an ovine hyaluronidase purified from ovine testicular extracts (see U.S. Pat. Nos. 2,488,564, 2,488,565 and 2,806, 815 and International PCT Application No. WO2005/ 118799). Examples of commercially available purified ovine testicular extract include Vitrase®, and ovine hyaluronidases, including, but not limited to, those available from Sigma Aldrich, Cell Sciences, EMD Chemicals, GenWay Biotech, Inc., Mybiosource.com and Raybiotech, Inc. Also included are recombinantly produced ovine hyaluronidases, such as, but not limited to, those generated by expression of a nucleic acid molecule set forth in any of SEQ ID NOS:66 and 193-194.

As used herein, "PH20" refers to a type of hyaluronidase that occurs in sperm and is neutral-active. PH-20 occurs on the sperm surface, and in the lysosome-derived acrosome, where it is bound to the inner acrosomal membrane. PH20 includes those of any origin including, but not limited to, human, chimpanzee, Cynomolgus monkey, Rhesus monkey, murine, bovine, ovine, guinea pig, rabbit and rat origin. Exemplary PH20 polypeptides include those from human (SEQ ID NO:1), chimpanzee (SEQ ID NO:101), Rhesus monkey (SEQ ID NO:102), Cynomolgus monkey (SEQ ID NO:29), cow (SEQ ID NOS:11 and 64), mouse (SEQ ID NO:32), rat (SEQ ID NO:31), rabbit (SEQ ID NO:25), sheep (SEQ ID NOS:27, 63 and 65) and guinea pig (SEQ ID NO:30).

Reference to hyaluronan-degrading enzymes includes precursor hyaluronan-degrading enzyme polypeptides and mature hyaluronan-degrading enzyme polypeptides (such as those in which a signal sequence has been removed), truncated forms thereof that have activity, and includes allelic variants and species variants, variants encoded by splice variants, and other variants, including polypeptides that have at least 40%, 45%, 50%, 55%, 65%, 70%, 75%, 80%, 85%, 90%, 95%, 96%, 97%, 98%, 99% or more sequence identity to the precursor polypeptides set forth in SEQ ID NOS: 1 and 10-48, 63-65, 67-102, or the mature forms thereof. For example, reference to hyaluronan-degrading enzyme also includes the human PH20 precursor polypeptide variants set forth in SEQ ID NOS:50-51. Hyaluronan-degrading enzymes also include those that contain chemical or posttranslational modifications and those that do not contain chemical or post-translational modifications. Such modifications include, but are not limited to, PEGylation, albumination, glycosylation, farnesylation, carboxylation, hydroxylation, phosphorylation, and other polypeptide modifications known in the art. A truncated PH20 hyaluronidase is any C-terminal shortened form thereof, particularly forms that are truncated and neutral active when N-glycosylated.

As used herein, a "soluble PH20" refers to any form of PH20 that is soluble under physiologic conditions. A soluble PH20 can be identified, for example, by its partitioning into the aqueous phase of a Triton® X-114 solution at 37° C.

(Bordier et al., (1981) *J. Biol. Chem.*, 256:1604-7). Membrane-anchored PH20, such as lipid-anchored PH20, including GPI-anchored PH20, will partition into the detergent-rich phase, but will partition into the detergent-poor or aqueous phase following treatment with Phospholipase-C. Included among soluble PH20 are membrane-anchored PH20 in which one or more regions associated with anchoring of the PH20 to the membrane has been removed or modified, where the soluble form retains hyaluronidase activity. Soluble PH20 also include recombinant soluble PH20 and those contained in or purified from natural sources, such as, for example, testes extracts from sheep or cows. Exemplary of such soluble PH20 is soluble human PH20.

As used herein, soluble human PH20 or sHuPH20 includes PH20 polypeptides lacking all or a portion of the glycosylphosphatidylinositol (GPI) anchor sequence at the C-terminus such that upon expression, the polypeptides are soluble under physiological conditions. Solubility can be assessed by any suitable method that demonstrates solubility under physiologic conditions. Exemplary of such methods is the Triton® X-114 assay, that assesses partitioning into the aqueous phase and that is described above and in the examples. In addition, a soluble human PH20 polypeptide is, if produced in CHO cells, such as CHO-S cells, a polypeptide that is expressed and is secreted into the cell culture medium. Soluble human PH20 polypeptides, however, are not limited to those produced in CHO cells, but can be produced in any cell or by any method, including recombinant expression and polypeptide synthesis. Reference to secretion in CHO cells is definitional. Hence, if a polypeptide could be expressed and secreted in CHO cells and is soluble, i.e. partitions into the aqueous phase when extracted with Triton® X-114, it is a soluble PH20 polypeptide whether or not it is so-produced. The precursor polypeptides for sHuPH20 polypeptides can include a signal sequence, such as a heterologous or non-heterologous (i.e. native) signal sequence. Exemplary of the precursors are those that include a signal sequence, such as the native 35 amino acid signal sequence at amino acid positions 1-35 (see, e.g., amino acids 1-35 of SEQ ID NO:1).

As used herein, an "extended soluble PH20" or "esPH20" includes soluble PH20 polypeptides that contain residues up to the GPI anchor-attachment signal sequence and one or more contiguous residues from the GPI-anchor attachment signal sequence such that the esPH20 is soluble under physiological conditions. Solubility under physiological conditions can be determined by any method known to those of skill in the art. For example, it can be assessed by the Triton® X-114 assay described above and in the examples. In addition, as discussed above, a soluble PH20 is, if produced in CHO cells, such as CHO-S cells, a polypeptide that is expressed and is secreted into the cell culture medium. Soluble human PH20 polypeptides, however, are not limited to those produced in CHO cells, but can be produced in any cell or by any method, including recombinant expression and polypeptide synthesis. Reference to secretion in CHO cells is definitional. Hence, if a polypeptide could be expressed and secreted in CHO cells and is soluble, i.e. partitions into the aqueous phase when extracted with Triton® X-114, it is a soluble PH20 polypeptide whether or not it is so-produced. Human soluble esPH20 polypeptides include, in addition to residues 36-490, one or more contiguous amino acids from amino acid residue position 491 of SEQ ID NO:1, inclusive, such that the resulting polypeptide is soluble. Exemplary human esPH20 soluble polypeptides are those that have amino acids residues corresponding to amino acids 36-491, 36-492, 36-493, 36-494, 36-495, 36-496 and 36-497 of SEQ ID NO:1. Exemplary of these are those with an amino acid sequence set forth in any of SEQ ID NOS:151-154 and 185-187. Also included are allelic variants and other variants, such as any with 40%, 45%, 50%, 55%, 65%, 70%, 75%, 80%, 85%, 90%, 91%, 92%, 93%, 94%, 95%, 96%, 97%, 98%, 99% or greater sequence identity with the corresponding polypeptides of SEQ ID NOS:151-154 and 185-187 that retain neutral activity and are soluble. Reference to sequence identity refers to variants with amino acid substitutions.

As used herein, reference to "esPH20s" includes precursor esPH20 polypeptides and mature esPH20 polypeptides (such as those in which a signal sequence has been removed), truncated forms thereof that have enzymatic activity (retaining at least 1%, 10%, 20%, 30%, 40%, 50% or more of the full-length form) and are soluble, and includes allelic variants and species variants, variants encoded by splice variants, and other variants, including polypeptides that have at least 40%, 45%, 50%, 55%, 65%, 70%, 75%, 80%, 85%, 90%, 91%, 92%, 93%, 94%, 95%, 96%, 97%, 98%, 99% or more sequence identity to the precursor polypeptides set forth in SEQ ID NOS:1 and 3, or the mature forms thereof.

As used herein, reference to "esPH20s" also include those that contain chemical or posttranslational modifications and those that do not contain chemical or posttranslational modifications. Such modifications include, but are not limited to, PEGylation, albumination, glycosylation, farnesylation, carboxylation, hydroxylation, phosphorylation, and other polypeptide modifications known in the art.

As used herein, "soluble recombinant human PH20 (rHuPH20)" refers to a composition containing solubles form of human PH20 as recombinantly expressed and secreted in Chinese Hamster Ovary (CHO) cells. Soluble rHuPH20 is encoded by nucleic acid molecule that includes a signal sequence and is set forth in SEQ ID NO:49. The nucleic acid encoding soluble rHuPH20 is expressed in CHO cells which secrete the mature polypeptide. As produced in the culture medium, there is heterogeneity at the C-terminus so that the product includes a mixture of species that can include any one or more amino acids 36-481 and 36-482 of PH20 (e.g., SEQ ID NO:4 to SEQ ID NO:9) in various abundance.

Similarly, for other forms of PH20, such as the esPH20s, recombinantly expressed polypeptides and compositions thereof can include a plurality of species whose C-terminus exhibits heterogeneity. For example, compositions of recombinantly expressed esPH20 produced by expression of the polypeptide of SEQ ID NO:151, which encodes an esPH20 that has amino acids 36-497, can include forms with fewer amino acids, such as 36-496, 36-495.

As used herein, an "N-linked moiety" refers to an asparagine (N) amino acid residue of a polypeptide that is capable of being glycosylated by post-translational modification of a polypeptide. Exemplary N-linked moieties of human PH20 include amino acids N82, N166, N235, N254, N368 and N393 of human PH20 set forth in SEQ ID NO:1.

As used herein, an "N-glycosylated polypeptide" refers to a PH20 polypeptide or truncated form thereto containing oligosaccharide linkage of at least three N-linked amino acid residues, for example, N-linked moieties corresponding to amino acid residues N235, N368 and N393 of SEQ ID NO:1. An N-glycosylated polypeptide can include a polypeptide where three, four, five and up to all of the N-linked moieties are linked to an oligosaccharide. The N-linked oligosaccharides can include oligomannose, complex, hybrid or sulfated oligosaccharides, or other oligosaccharides and monosaccharides.

As used herein, an "N-partially glycosylated polypeptide" refers to a polypeptide that minimally contains an N-acetylglucosamine glycan linked to at least three N-linked moieties.

A partially glycosylated polypeptide can include various glycan forms, including monosaccharides, oligosaccharides, and branched sugar forms, including those formed by treatment of a polypeptide with EndoH, EndoF1, EndoF2 and/or EndoF3.

As used herein, a "deglycosylated PH20 polypeptide" refers to a PH20 polypeptide in which fewer than all possible glycosylation sites are glycosylated. Deglycosylation can be effected, for example, by removing glycosylation, by preventing it, or by modifying the polypeptide to eliminate a glycosylation site. Particular N-glycosylation sites are not required for activity, whereas others are.

As used herein, "PEGylated" refers to covalent or other stable attachment of polymeric molecules, such as polyethylene glycol (PEGylation moiety PEG) to hyaluronan-degrading enzymes, such as hyaluronidases, typically to increase half-life of the hyaluronan-degrading enzyme.

As used herein, a "conjugate" refers to a polypeptide linked directly or indirectly to one or more other polypeptides or chemical moieties. Such conjugates include fusion proteins, those produced by chemical conjugates and those produced by any other methods. For example, a conjugate refers to soluble PH20 polypeptides linked directly or indirectly to one or more other polypeptides or chemical moieties, whereby at least one soluble PH20 polypeptide is linked, directly or indirectly to another polypeptide or chemical moiety so long as the conjugate retains hyaluronidase activity.

As used herein, a "fusion" protein refers to a polypeptide encoded by a nucleic acid sequence containing a coding sequence from one nucleic acid molecule and the coding sequence from another nucleic acid molecule in which the coding sequences are in the same reading frame such that when the fusion construct is transcribed and translated in a host cell, the protein is produced containing the two proteins. The two molecules can be adjacent in the construct or separated by a linker polypeptide that contains, 1, 2, 3, or more, but typically fewer than 10, 9, 8, 7, or 6 amino acids. The protein product encoded by a fusion construct is referred to as a fusion polypeptide.

As used herein, a "polymer" refers to any high molecular weight natural or synthetic moiety that is conjugated to, i.e. stably linked directly or indirectly via a linker, to a polypeptide. Such polymers, typically increase serum half-life, and include, but are not limited to sialic moieties, PEGylation moieties, dextran, and sugar and other moieties, such as for glycosylation. For example, hyaluronidases, such as a soluble PH20 or rHuPH20, can be conjugated to a polymer.

As used herein, a hyaluronidase substrate refers to a substrate (e.g. protein or polysaccharide) that is cleaved and/or depolymerized by a hyaluronidase enzyme. Generally, a hyaluronidase substrate is a glycosaminoglycan. An exemplary hyaluronidase substrate is hyaluronan (HA).

As used herein, a hyaluronan-associated disease, disorder or condition refers to any disease or condition in which hyaluronan levels are elevated as cause, consequence or otherwise observed in the disease or condition. Hyaluronan-associated diseases and conditions are associated with elevated hyaluronan expression in a tissue or cell, increased interstitial fluid pressure, decreased vascular volume, and/or increased water content in a tissue. Hyaluronan-associated diseases, disorders or conditions can be treated by administration of a composition containing an anti-hyaluronan agent, such as a hyaluronan-degrading enzyme, such as a hyaluronidase, for example, a soluble hyaluronidase, either alone or in combination with or in addition to another treatment and/or agent. Exemplary diseases and conditions, include, but are not limited to, inflammatory diseases and hyaluronan-rich cancers. Hyaluronan rich cancers include, for example, tumors including solid tumors such as late-stage cancers, a metastatic cancers, undifferentiated cancers, ovarian cancer, in situ carcinoma (ISC), squamous cell carcinoma (SCC), prostate cancer, pancreatic cancer, non-small cell lung cancer, breast cancer, colon cancer and other cancers. Also exemplary of hyaluronan-associated diseases and conditions are diseases that are associated with elevated interstitial fluid pressure, such as diseases associated with disc pressure, and edema, for example, edema caused by organ transplant, stroke, brain trauma or other injury. Exemplary hyaluronan-associated diseases and conditions include diseases and conditions associated with elevated interstitial fluid pressure, decreased vascular volume, and/or increased water content in a tissue, including cancers, disc pressure and edema. In one example, treatment of the hyaluronan-associated condition, disease or disorder includes amelioration, reduction, or other beneficial effect on one or more of increased interstitial fluid pressure (IFP), decreased vascular volume, and increased water content in a tissue.

As used herein, "activity" refers to a functional activity or activities of a polypeptide or portion thereof associated with a full-length (complete) protein. For example, active fragments of a polypeptide can exhibit an activity of a full-length protein. Functional activities include, but are not limited to, biological activity, catalytic or enzymatic activity, antigenicity (ability to bind or compete with a polypeptide for binding to an anti-polypeptide antibody), immunogenicity, ability to form multimers, and the ability to specifically bind to a receptor or ligand for the polypeptide.

As used herein, "hyaluronidase activity" refers to the ability to enzymatically catalyze the cleavage of hyaluronic acid. The United States Pharmacopeia (USP) XXII assay for hyaluronidase determines hyaluronidase activity indirectly by measuring the amount of higher molecular weight hyaluronic acid, or hyaluronan, (HA) substrate remaining after the enzyme is allowed to react with the HA for 30 min at 37° C. (USP XXII-NF XVII (1990) 644-645 United States Pharmacopeia Convention, Inc, Rockville, Md.). A Reference Standard solution can be used in an assay to ascertain the relative activity, in units, of any hyaluronidase. In vitro assays to determine the hyaluronidase activity of hyaluronidases, such as PH20, including soluble PH20 and esPH20, are known in the art and described herein. Exemplary assays include the microturbidity assay that measures cleavage of hyaluronic acid by hyaluronidase indirectly by detecting the insoluble precipitate formed when the uncleaved hyaluronic acid binds with serum albumin and the biotinylated-hyaluronic acid assay that measures the cleavage of hyaluronic acid indirectly by detecting the remaining biotinylated-hyaluronic acid non-covalently bound to microtiter plate wells with a streptavidin-horseradish peroxidase conjugate and a chromogenic substrate. Reference Standards can be used, for example, to generate a standard curve to determine the activity in Units of the hyaluronidase being tested.

As used herein, specific activity refers to Units of activity per mg protein. The milligrams of hyaluronidase is defined by the absorption of a solution of at 280 nm assuming a molar extinction coefficient of approximately 1.7, in units of $M^{-1} cm^{-1}$.

As used herein, "neutral active" refers to the ability of a PH20 polypeptide to enzymatically catalyze the cleavage of hyaluronic acid at neutral pH (e.g. at or about pH 7.0). Generally, a neutral active and soluble PH20, e.g., C-terminally truncated or N-partially glycosylated PH20, has or has about 30%, 40%, 50%, 60%, 70%, 80%, 90%, 91%, 92%, 93%, 94%, 95%, 96%, 97%, 98%, 99%, 100%, 110%, 120%, 130%, 140%, 150%, 200%, 300%, 400%, 500%, 1000% or more activity compared to the hyaluronidase activity of a corresponding neutral active PH20 that is not C-terminally truncated or N-partially glycosylated.

As used herein, a "GPI-anchor attachment signal sequence" is a C-terminal sequence of amino acids that directs addition of a preformed GPI-anchor to the polypeptide within the lumen of the ER. GPI-anchor attachment signal sequences are present in the precursor polypeptides of GPI-anchored polypeptides, such as GPI-anchored PH20 polypeptides. The C-terminal GPI-anchor attachment signal sequence typically contains a predominantly hydrophobic region of 8-20 amino acids, preceded by a hydrophilic spacer region of 8-12 amino acids, immediately downstream of the ω-site, or site of GPI-anchor attachment. GPI-anchor attachment signal sequences can be identified using methods well known in the art. These include, but are not limited to, in silico methods and algorithms (see, e.g. Udenfriend et al. (1995) *Methods Enzymol.* 250:571-582, Eisenhaber et al., (1999) *J. Biol. Chem.* 292: 741-758, Fankhauser et al., (2005) *Bioinformatics* 21:1846-1852, Omaetxebarria et al., (2007) *Proteomics* 7:1951-1960, Pierleoni et al., (2008) BMC Bioinformatics 9:392), including those that are readily available on bioinformatic websites, such as the ExPASy Proteomics tools site (e.g., the WorldWideWeb site expasy.ch/tools/).

As used herein, "nucleic acids" include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleic acids long.

As used herein, a peptide refers to a polypeptide that is greater than or equal to 2 amino acids in length, and less than or equal to 40 amino acids in length.

As used herein, the amino acids which occur in the various sequences of amino acids provided herein are identified according to their known, three-letter or one-letter abbreviations (Table 1). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain).

As used herein, "amino acid residue" refers to an amino acid formed upon chemical digestion (hydrolysis) of a polypeptide at its peptide linkages. The amino acid residues described herein are presumed to be in the "L" isomeric form. Residues in the "D" isomeric form, which are so designated, can be substituted for any L-amino acid residue as long as the desired functional property is retained by the polypeptide. NH2 refers to the free amino group present at the amino terminus of a polypeptide. COOH refers to the free carboxy group present at the carboxyl terminus of a polypeptide. In keeping with standard polypeptide nomenclature described in J. Biol. Chem., 243: 3557-3559 (1968), and adopted 37 C.F.R. §§1.821-1.822, abbreviations for amino acid residues are shown in Table 1:

TABLE 1

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | Proline |
| K | Lys | Lysine |
| H | His | Histidine |
| Q | Gln | Glutamine |
| E | Glu | Glutamic acid |
| Z | Glx | Glu and/or Gln |
| W | Trp | Tryptophan |
| R | Arg | Arginine |
| D | Asp | Aspartic acid |
| N | Asn | Asparagine |
| B | Asx | Asn and/or Asp |
| C | Cys | Cysteine |
| X | Xaa | Unknown or other |

All amino acid residue sequences represented herein by formulae have a left to right orientation in the conventional direction of amino-terminus to carboxyl-terminus. In addition, the phrase "amino acid residue" is defined to include the amino acids listed in the Table of Correspondence (Table 1) and modified and unusual amino acids, such as those referred to in 37 C.F.R. §§1.821-1.822, and incorporated herein by reference. Furthermore, it should be noted that a dash at the beginning or end of an amino acid residue sequence indicates a peptide bond to a further sequence of one or more amino acid residues, to an amino-terminal group such as NH$_2$ or to a carboxyl-terminal group such as COOH.

As used herein, the "naturally occurring α-amino acids" are the residues of those 20 α-amino acids found in nature which are incorporated into protein by the specific recognition of the charged tRNA molecule with its cognate mRNA codon in humans. Non-naturally occurring amino acids thus include, for example, amino acids or analogs of amino acids other than the 20 naturally-occurring amino acids and include, but are not limited to, the D-stereoisomers of amino acids. Exemplary non-natural amino acids are described herein and are known to those of skill in the art.

As used herein, a DNA construct is a single- or double-stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule may not be paired. Such unpaired ends will, in general, not exceed 20 nucleotides in length.

As used herein, "similarity" between two proteins or nucleic acids refers to the relatedness between the sequence of amino acids of the proteins or the nucleotide sequences of the nucleic acids. Similarity can be based on the degree of identity and/or homology of sequences of residues and the residues contained therein. Methods for assessing the degree of similarity between proteins or nucleic acids are known to those of skill in the art. For example, in one method of assessing sequence similarity, two amino acid or nucleotide sequences are aligned in a manner that yields a maximal level of identity between the sequences. "Identity" refers to the extent to which the amino acid or nucleotide sequences are invariant. Alignment of amino acid sequences, and to some extent nucleotide sequences, also can take into account conservative differences and/or frequent substitutions in amino acids (or nucleotides). Conservative differences are those that preserve the physico-chemical properties of the residues involved. Alignments can be global (alignment of the compared sequences over the entire length of the sequences and including all residues) or local (the alignment of a portion of the sequences that includes only the most similar region or regions).

"Identity" per se has an art-recognized meaning and can be calculated using published techniques. (See, e.g. Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part I, Griffin, A. M., and Griffin, H. G., eds., Humana Press, New Jersey, 1994; Sequence Analysis in Molecular Biology, von Heinje, G., Academic Press, 1987; and Sequence Analysis Primer, Gribskov, M. and Devereux, J., eds., M Stockton Press, New York, 1991). While there exists a number of methods to measure identity between two polynucleotide or polypeptides, the term "identity" is well known to skilled artisans (Carrillo, H. and Lipton, D., (1988) SIAM J Applied Math 48:1073).

As used herein, homologous (with respect to nucleic acid and/or amino acid sequences) means about greater than or equal to 25% sequence homology, typically greater than or equal to 25%, 40%, 50%, 60%, 70%, 80%, 85%, 90% or 95% sequence homology; the precise percentage can be specified if necessary. For purposes herein the terms "homology" and "identity" are often used interchangeably, unless otherwise indicated. In general, for determination of the percentage homology or identity, sequences are aligned so that the highest order match is obtained (see, e.g.: Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part I, Griffin, A. M., and Griffin, H. G., eds., Humana Press, New Jersey, 1994; Sequence Analysis in Molecular Biology, von Heinje, G., Academic Press, 1987; and Sequence Analysis Primer, Gribskov, M. and Devereux, J., eds., M Stockton Press, New York, 1991; Carrillo, H. and Lipton, D., (1988) SIAM J Applied Math 48:1073). By sequence homology, the number of conserved amino acids is determined by standard alignment algorithms programs, and can be used with default gap penalties established by each supplier. Substantially homologous nucleic acid molecules would hybridize typically at moderate stringency or at high stringency all along the length of the nucleic acid of interest. Also contemplated are nucleic acid molecules that contain degenerate codons in place of codons in the hybridizing nucleic acid molecule.

Whether any two molecules have nucleotide sequences or amino acid sequences that are at least 60%, 70%, 80%, 85%, 90%, 95%, 96%, 97%, 98% or 99% "identical" or "homologous" can be determined using known computer algorithms such as the "FASTA" program, using for example, the default parameters as in Pearson et al. (1988) Proc. Natl. Acad. Sci. USA 85:2444 (other programs include the GCG program package (Devereux, J., et al., Nucleic Acids Research 12(I): 387 (1984)), BLASTP, BLASTN, FASTA (Altschul, S. F., et al., J Mol Biol 215:403 (1990)); Guide to Huge Computers, Martin J. Bishop, ed., Academic Press, San Diego, 1994, and Carrillo, H. and Lipton, D., (1988) SIAM J Applied Math 48:1073). For example, the BLAST function of the National Center for Biotechnology Information database can be used to determine identity. Other commercially or publicly available programs include, DNAStar "MegAlign" program (Madison, Wis.) and the University of Wisconsin Genetics Computer Group (UWG) "Gap" program (Madison Wis.). Percent homology or identity of proteins and/or nucleic acid molecules can be determined, for example, by comparing sequence information using a GAP computer program (e.g., Needleman et al. (1970) J. Mol. Biol. 48:443, as revised by Smith and Waterman ((1981) Adv. Appl. Math. 2:482). Briefly, the GAP program defines similarity as the number of aligned symbols (i.e., nucleotides or amino acids), which are similar, divided by the total number of symbols in the shorter of the two sequences. Default parameters for the GAP program can include: (1) a unary comparison matrix (containing a value of 1 for identities and 0 for non-identities) and the weighted comparison matrix of Gribskov et al. (1986) Nucl. Acids Res. 14:6745, as described by Schwartz and Dayhoff, eds., ATLAS OF PROTEIN SEQUENCE AND STRUCTURE, National Biomedical Research Foundation, pp. 353-358 (1979); (2) a penalty of 3.0 for each gap and an additional 0.10 penalty for each symbol in each gap; and (3) no penalty for end gaps.

Therefore, as used herein, the term "identity" or "homology" represents a comparison between a test and a reference polypeptide or polynucleotide. As used herein, the term at least "90% identical to" refers to percent identities from 90 to 99.99 relative to the reference nucleic acid or amino acid sequence of the polypeptide. Identity at a level of 90% or more is indicative of the fact that, assuming for exemplification purposes a test and reference polypeptide length of 100 amino acids are compared. No more than 10% (i.e., 10 out of 100) of the amino acids in the test polypeptide differs from that of the reference polypeptide. Similar comparisons can be made between test and reference polynucleotides. Such differences can be represented as point mutations randomly distributed over the entire length of a polypeptide or they can be clustered in one or more locations of varying length up to the maximum allowable, e.g. 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often by manual alignment without relying on software.

As used herein, an aligned sequence refers to the use of homology (similarity and/or identity) to align corresponding positions in a sequence of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence.

As used herein, "primer" refers to a nucleic acid molecule that can act as a point of initiation of template-directed DNA synthesis under appropriate conditions (e.g., in the presence of four different nucleoside triphosphates and a polymerization agent, such as DNA polymerase, RNA polymerase or reverse transcriptase) in an appropriate buffer and at a suitable temperature. It will be appreciated that certain nucleic acid molecules can serve as a "probe" and as a "primer." A primer, however, has a 3' hydroxyl group for extension. A primer can be used in a variety of methods, including, for example, polymerase chain reaction (PCR), reverse-transcriptase (RT)-PCR, RNA PCR, LCR, multiplex PCR, panhandle PCR, capture PCR, expression PCR, 3' and 5' RACE, in situ PCR, ligation-mediated PCR and other amplification protocols.

As used herein, "primer pair" refers to a set of primers that includes a 5' (upstream) primer that hybridizes with the complement of the 5' end of a sequence to be amplified (e.g. by PCR) and a 3' (downstream) primer that hybridizes with the 3' end of the sequence to be amplified.

As used herein, "specifically hybridizes" refers to annealing, by complementary base-pairing, of a nucleic acid molecule (e.g. an oligonucleotide) to a target nucleic acid molecule. Those of skill in the art are familiar with in vitro and in vivo parameters that affect specific hybridization, such as length and composition of the particular molecule. Parameters particularly relevant to in vitro hybridization further include annealing and washing temperature, buffer composition and salt concentration. Exemplary washing conditions for removing non-specifically bound nucleic acid molecules at high stringency are 0.1×SSPE, 0.1% SDS, 65° C., and at medium stringency are 0.2×SSPE, 0.1% SDS, 50° C. Equivalent stringency conditions are known in the art. The skilled person can readily adjust these parameters to achieve specific hybridization of a nucleic acid molecule to a target nucleic acid molecule appropriate for a particular application. Complementary, when referring to two nucleotide sequences, means that the two sequences of nucleotides are capable of hybridizing, typically with less than 25%, 15% or 5% mismatches between opposed nucleotides. If necessary, the percentage of complementarity will be specified. Typically the two molecules are selected such that they will hybridize under conditions of high stringency.

As used herein, substantially identical to a product means sufficiently similar so that the property of interest is sufficiently unchanged so that the substantially identical product can be used in place of the product.

As used herein, it also is understood that the terms "substantially identical" or "similar" varies with the context as understood by those skilled in the relevant art.

As used herein, an allelic variant or allelic variation references any of two or more alternative forms of a gene occupying the same chromosomal locus. Allelic variation arises naturally through mutation, and can result in phenotypic polymorphism within populations. Gene mutations can be silent (no change in the encoded polypeptide) or can encode polypeptides having altered amino acid sequence. The term "allelic variant" also is used herein to denote a protein encoded by an allelic variant of a gene. Typically the reference form of the gene encodes a wildtype form and/or predominant form of a polypeptide from a population or single reference member of a species. Typically, allelic variants, which include variants between and among species typically have at least 80%, 90% or greater amino acid identity with a wildtype and/or predominant form from the same species; the degree of identity depends upon the gene and whether comparison is interspecies or intraspecies. Generally, intraspecies allelic variants have at least about 80%, 85%, 90%, 95% or greater identity with a wildtype and/or predominant form, including 96%, 97%, 98%, 99% or greater identity with a wildtype and/or predominant form of a polypeptide. Reference to an allelic variant herein generally refers to variations in proteins among members of the same species.

As used herein, "allele," which is used interchangeably herein with "allelic variant" refers to alternative forms of a gene or portions thereof. Alleles occupy the same locus or position on homologous chromosomes. When a subject has two identical alleles of a gene, the subject is said to be homozygous for that gene or allele. When a subject has two different alleles of a gene, the subject is said to be heterozygous for the gene. Alleles of a specific gene can differ from each other in a single nucleotide or several nucleotides, and can include modifications such as substitutions, deletions and insertions of nucleotides. An allele of a gene also can be a form of a gene containing a mutation.

As used herein, species variants refer to variants in polypeptides among different species, including different mammalian species, such as mouse and human. For example for PH20, exemplary of species variants provided herein are primate PH20, such as, but not limited to, human, chimpanzee, macaque and cynomolgus monkey. Generally, species variants have 70%, 75%, 80%, 85%, 90%, 91%, 92%, 93%, 94%, 95%, 96%, 97%, 98% or greater sequence identity. Corresponding residues between and among species variants can be determined by comparing and aligning sequences to maximize the number of matching nucleotides or residues, for example, such that identity between the sequences is equal to or greater than 95%, equal to or greater than 96%, equal to or greater than 97%, equal to or greater than 98% or equal to greater than 99%. The position of interest is then given the number assigned in the reference nucleic acid molecule. Alignment can be effected manually or by eye, particularly, where sequence identity is greater than 80%.

As used herein, a human protein is one encoded by a nucleic acid molecule, such as DNA, present in the genome of a human, including all allelic variants and conservative variations thereof. A variant or modification of a protein is a human protein if the modification is based on the wildtype or prominent sequence of a human protein.

As used herein, a splice variant refers to a variant produced by differential processing of a primary transcript of genomic DNA that results in more than one type of mRNA.

As used herein, modification is in reference to modification of a sequence of amino acids of a polypeptide or a sequence of nucleotides in a nucleic acid molecule and includes deletions, insertions, and replacements (e.g. substitutions) of amino acids and nucleotides, respectively. Exemplary of modifications are amino acid substitutions. An amino-acid substituted polypeptide can exhibit 65%, 70%, 80%, 85%, 90%, 91%, 92%, 93%, 94%, 95%, 96%, 97%, 98% or more sequence identity to a polypeptide not containing the amino acid substitutions. Amino acid substitutions can be conservative or non-conservative. Generally, any modification to a polypeptide retains an activity of the polypeptide. Methods of modifying a polypeptide are routine to those of skill in the art, such as by using recombinant DNA methodologies.

As used herein, suitable conservative substitutions of amino acids are known to those of skill in this art and can be made generally without altering the biological activity of the resulting molecule. Those of skill in this art recognize that, in general, single amino acid substitutions in non-essential regions of a polypeptide do not substantially alter biological activity (see, e.g., Watson et al. Molecular Biology of the Gene, 4th Edition, 1987, The Benjamin/Cummings Pub. co., p. 224). Such substitutions can be made in accordance with those set forth in TABLE 2 as follows:

TABLE 2

| Original residue | Exemplary conservative substitution |
| --- | --- |
| Ala (A) | Gly; Ser |
| Arg (R) | Lys |
| Asn (N) | Gln; His |
| Cys (C) | Ser |
| Gln (Q) | Asn |
| Glu (E) | Asp |
| Gly (G) | Ala; Pro |
| His (H) | Asn; Gln |
| Ile (I) | Leu; Val |
| Leu (L) | Ile; Val |
| Lys (K) | Arg; Gln; Glu |
| Met (M) | Leu; Tyr; Ile |
| Phe (F) | Met; Leu; Tyr |
| Ser (S) | Thr |
| Thr (T) | Ser |
| Trp (W) | Tyr |
| Tyr (Y) | Trp; Phe |
| Val (V) | Ile; Leu |

Other substitutions also are permissible and can be determined empirically or in accord with known conservative substitutions.

As used herein, the term promoter means a portion of a gene containing DNA sequences that provide for the binding of RNA polymerase and initiation of transcription. Promoter sequences are commonly, but not always, found in the 5' non-coding region of genes.

As used herein, isolated or purified polypeptide or protein or biologically-active portion thereof is substantially free of cellular material or other contaminating proteins from the cell or tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as enzymatic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

Hence, reference to a substantially purified polypeptide, such as a substantially purified soluble PH20, refers to preparations of proteins that are substantially free of cellular material, which includes preparations of proteins in which the protein is separated from cellular components of the cells from which it is isolated or recombinantly-produced. In one embodiment, the term substantially free of cellular material includes preparations of enzyme proteins having less than about 30% (by dry weight) of non-enzyme proteins (also referred to herein as a contaminating protein), generally less than about 20% of non-enzyme proteins or 10% of non-enzyme proteins or less than about 5% of non-enzyme proteins. When the enzyme protein is recombinantly produced, it also is substantially free of culture medium, i.e., culture medium represents less than about or at 20%, 10% or 5% of the volume of the enzyme protein preparation.

As used herein, the term substantially free of chemical precursors or other chemicals includes preparations of enzyme proteins in which the protein is separated from chemical precursors or other chemicals that are involved in the synthesis of the protein. The term includes preparations of enzyme proteins having less than about 30% (by dry weight), 20%, 10%, 5% or less of chemical precursors or non-enzyme chemicals or components.

As used herein, synthetic, with reference to, for example, a synthetic nucleic acid molecule or a synthetic gene or a synthetic peptide refers to a nucleic acid molecule or polypeptide molecule that is produced by recombinant methods and/or by chemical synthesis methods.

As used herein, production by recombinant means or using recombinant DNA methods means the use of the well known methods of molecular biology for expressing proteins encoded by cloned DNA.

As used herein, vector (or plasmid) refers to discrete elements that are used to introduce a heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as yeast artificial chromosomes and mammalian artificial chromosomes. Selection and use of such vehicles are well known to those of skill in the art.

As used herein, an expression vector includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses that are operatively linked to exogenous genes to transfer (as vehicles or shuttles) the exogenous genes into cells.

As used herein, "operably" or "operatively linked" when referring to DNA segments means that the segments are arranged so that they function in concert for their intended purposes, e.g., transcription initiates downstream of the promoter and upstream of any transcribed sequences. The promoter is usually the domain to which the transcriptional machinery binds to initiate transcription and proceeds through the coding segment to the terminator.

As used herein the term "assessing" is intended to include quantitative and qualitative determination in the sense of obtaining an absolute value for the activity of a protein, such as an enzyme, or a domain thereof, present in the sample, and also of obtaining an index, ratio, percentage, visual or other value indicative of the level of the activity. Assessment can be direct or indirect. For example, the chemical species actually detected need not of course be the enzymatically cleaved product itself but can for example be a derivative thereof or some further substance. For example, detection of a cleavage product can be a detectable moiety such as a fluorescent moiety.

As used herein, biological activity refers to the in vivo activities of a compound or physiological responses that result upon in vivo administration of a compound, composition or other mixture. Biological activity, thus, encompasses therapeutic effects and pharmaceutical activity of such compounds, compositions and mixtures. Biological activities can be observed in in vitro systems designed to test or use such activities. Thus, for purposes herein a biological activity of a hyaluronidase enzyme is its degradation of hyaluronic acid.

As used herein equivalent, when referring to two sequences of nucleic acids, means that the two sequences in question encode the same sequence of amino acids or equivalent proteins. When equivalent is used in referring to two proteins or peptides, it means that the two proteins or peptides have substantially the same amino acid sequence with only amino acid substitutions that do not substantially alter the activity or function of the protein or peptide. When equivalent refers to a property, the property does not need to be present to the same extent (e.g., two peptides can exhibit different rates of the same type of enzymatic activity), but the activities are usually substantially the same.

As used herein, "modulate" and "modulation" or "alter" refer to a change of an activity of a molecule, such as a protein. Exemplary activities include, but are not limited to, biological activities, such as signal transduction. Modulation can include an increase in the activity (i.e., up-regulation or agonist activity), a decrease in activity (i.e., down-regulation or inhibition) or any other alteration in an activity (such as a change in periodicity, frequency, duration, kinetics or other parameter). Modulation can be context dependent and typically modulation is compared to a designated state, for example, the wildtype protein, the protein in a constitutive state, or the protein as expressed in a designated cell type or condition.

As used herein, a composition refers to any mixture. It can be a solution, suspension, liquid, powder, paste, aqueous, non-aqueous or any combination thereof.

As used herein, a combination refers to any association between or among two or more items. The combination can be two or more separate items, such as two compositions or two collections, can be a mixture thereof, such as a single mixture of the two or more items, or any variation thereof. The elements of a combination are generally functionally associated or related. For example, a combination can be a combination of compositions provided herein.

As used herein a kit refers to a combination of components, such as a combination of the compositions herein and another item for a purpose including, but not limited to, reconstitution, activation, and instruments/devices for delivery, administration, diagnosis, and assessment of a biological activity or property. Kits optionally include instructions for use.

As used herein, "disease or disorder" refers to a pathological condition in an organism resulting from cause or condition including, but not limited to, infections, acquired conditions, genetic conditions, and characterized by identifiable symptoms. Diseases and disorders of interest herein are hyaluronan-associated diseases and disorders.

As used herein, "treating" a subject with a disease or condition means that the subject's symptoms are partially or totally alleviated, or remain static following treatment. Hence treatment encompasses prophylaxis, therapy and/or cure. Prophylaxis refers to prevention of a potential disease and/or a prevention of worsening of symptoms or progression of a disease.

As used herein, a pharmaceutically effective agent, includes any therapeutic agent or bioactive agents, including, but not limited to, for example, chemotherapeutics, anesthetics, vasoconstrictors, dispersing agents, conventional therapeutic drugs, including small molecule drugs and therapeutic proteins.

As used herein, treatment means any manner in which the symptoms of a condition, disorder or disease or other indication, are ameliorated or otherwise beneficially altered.

As used herein, therapeutic effect means an effect resulting from treatment of a subject that alters, typically improves or ameliorates the symptoms of a disease or condition or that cures a disease or condition. A therapeutically effective amount refers to the amount of a composition, molecule or compound which results in a therapeutic effect following administration to a subject.

As used herein, the term "subject" refers to an animal, including a mammal, such as a human being.

As used herein, a "patient" refers to a human subject exhibiting symptoms of a disease or disorder.

As used herein, an "individual" can be a subject.

As used herein, about the same means within an amount that one of skill in the art would consider to be the same or to be within an acceptable range of error. For example, typically, for pharmaceutical compositions, an amount within at least 1%, 2%, 3%, 4%, 5% or 10% is considered about the same. Such amount can vary depending upon the tolerance for variation in the particular composition by subjects.

As used herein, dosing regime refers to the amount of agent, for example, the composition containing a hyaluronan-degrading enzyme, for example a soluble hyaluronidase or other agent, administered, and the frequency of administration. The dosing regime is a function of the disease or condition to be treated, and thus can vary.

As used herein, frequency of administration refers to the time between successive administrations of treatment. For example, frequency can be days, weeks or months. For example, frequency can be more than once weekly, for example, twice a week, three times a week, four times a week, five times a week, six times a week or daily. Frequency also can be one, two, three or four weeks. The particular frequency is function of the particular disease or condition treated. Generally, frequency is more than once weekly, and generally is twice weekly.

As used herein, a "cycle of administration" refers to the repeated schedule of the dosing regime of administration of the enzyme and/or a second agent that is repeated over successive administrations. For example, an exemplary cycle of administration is a 28 day cycle with administration twice weekly for three weeks, followed by one-week of discontinued dosing.

As used herein, when referencing dosage based on mg/kg of the subject, an average human subject is considered to have a mass of about 70 kg-75 kg, such as 70 kg.

As used herein, amelioration of the symptoms of a particular disease or disorder by a treatment, such as by administration of a pharmaceutical composition or other therapeutic, refers to any lessening, whether permanent or temporary, lasting or transient, of the symptoms or, adverse effects of a condition, such as, for example, reduction of adverse effects associated with or that occur upon administration of a hyaluronan-degrading enzyme, such as a PEGylated hyaluronidase.

As used herein, prevention or prophylaxis refers to a reduction in the risk of developing a disease or condition.

As used herein, a "therapeutically effective amount" or a "therapeutically effective dose" refers to the quantity of an agent, compound, material, or composition containing a compound that is at least sufficient to produce a therapeutic effect. Hence, it is the quantity necessary for preventing, curing, ameliorating, arresting or partially arresting a symptom of a disease or disorder.

As used herein, unit dose form refers to physically discrete units suitable for human and animal subjects and packaged individually as is known in the art.

As used herein, a single dosage formulation refers to a formulation as a single dose.

As used herein, formulation for direct administration means that the composition does not require further dilution for administration.

As used herein, an "article of manufacture" is a product that is made and sold. As used throughout this application, the term is intended to encompass anti-hyaluronan agents, for example hyaluronan-degrading enzyme, such as hyaluronidase, and second agent compositions contained in articles of packaging.

As used herein, fluid refers to any composition that can flow. Fluids thus encompass compositions that are in the form of semi-solids, pastes, solutions, aqueous mixtures, gels, lotions, creams and other such compositions.

As used herein, a cellular extract or lysate refers to a preparation or fraction which is made from a lysed or disrupted cell.

As used herein, animal includes any animal, such as, but are not limited to primates including humans, gorillas and monkeys; rodents, such as mice and rats; fowl, such as chickens; ruminants, such as goats, cows, deer, sheep; pigs and other animals. Non-human animals exclude humans as the contemplated animal. The hyaluronidases provided herein are from any source, animal, plant, prokaryotic and fungal. Most hyaluronidases are of animal origin, including mammalian origin. Generally hyaluronidases are of human origin.

As used herein, anti-cancer treatments include administration of drugs and other agents for treating cancer, and also treatment protocols, such as surgery and radiation. Anti-cancer treatments include administration of anti-cancer agents.

As used herein, an anti-cancer agent refers to any agents, or compounds, used in anti-cancer treatment. These include any agents, when used alone or in combination with other compounds, that can alleviate, reduce, ameliorate, prevent, or place or maintain in a state of remission of clinical symptoms or diagnostic markers associated with tumors and cancer, and can be used in combinations and compositions provided herein. Exemplary anti-cancer agents include, but are not limited to, hyaluronan-degrading enzymes, such as the PEGylated hyaluronan-degrading enzymes provided herein used singly or in combination with other anti-cancer agents, such as chemotherapeutics, polypeptides, antibodies, peptides, small molecules or gene therapy vectors, viruses or DNA.

As used herein, a control refers to a sample that is substantially identical to the test sample, except that it is not treated with a test parameter, or, if it is a plasma sample, it can be from a normal volunteer not affected with the condition of interest. A control also can be an internal control.

As used herein, the singular forms "a," "an" and "the" include plural referents unless the context clearly dictates otherwise. Thus, for example, reference to a compound comprising or containing "an extracellular domain" includes compounds with one or a plurality of extracellular domains.

As used herein, ranges and amounts can be expressed as "about" a particular value or range. About also includes the exact amount. Hence "about 5 bases" means "about 5 bases" and also "5 bases." Generally "about" includes an amount that would be expected to be within experimental error.

As used herein, "optional" or "optionally" means that the subsequently described event or circumstance does or does not occur, and that the description includes instances where said event or circumstance occurs and instances where it does not. For example, an optionally substituted group means that the group is unsubstituted or is substituted.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726).

B. HYALURONAN BINDING PROTEIN AND COMPANION DIAGNOSTIC

Provided herein are sensitive and specific methods to detect and closely monitor hyaluronan (HA) levels associated with disease, particularly in the extracellular matrix (ECM) of tumor tissues. The companion diagnostic methods provided herein are based on the finding that HA accumulation specifically correlates with and predicts aggressive disease, in particular with respect to cancers. In addition, the companion diagnostic method provided herein also is based on the finding that HA specifically provides superior prognostic and treatment selection information as compared to other markers involved in the HA metabolic pathway associated with hyaluronan-associated diseases and conditions, such as hyaluronidase synthases or hyaluronidases. Hence, the method provided herein utilizes improved hyaluronan binding protein (HABP) reagents that exhibit specificity, high affinity and low variability for specific and sensitive detection of HA. Also provided herein are improved HABP reagents.

In one example, the improved HABPs provided herein, such as any described in Section C, can be a companion diagnostic for selecting patients with HA-associated diseases, for example HA-associated tumors, for treatment with an anti-hyaluronan agent or hyaluronan-degrading enzyme, such as any set forth in Section E (e.g. a hyaluronidase or modified hyaluronidase such as PEGylated PH20, i.e. PEGPH20). In such an example, the method is useful in classification of patients for selection of therapy, such as cancer therapy, and in particular relates to the measurement of HA levels that correlate with responsiveness to therapy with an anti-hyaluronan agent, for example a hyaluronan-degrading enzyme therapy, such as therapy by a PEGPH20 for treatment of patients with advanced tumors.

In another example, the improved HABPs provided herein, such as any described in Section C, also can be used in methods of monitoring efficacy or responsiveness to treatment with an anti-hyaluronan agent or hyaluronan-degrading enzyme such as any set forth in Section E (e.g. a hyaluronidase or modified hyaluronidase such as PEGylated PH20, i.e. PEGPH20) by detecting levels of HA during the treatment. Thus, the improved HABP can be used in conjunction with therapy with an anti-hyaluronan-agent, for example hyaluronan-degrading enzyme therapy, to monitor HA levels and to adjust and/or alter therapy to personalize individual treatment of a patient depending upon the particular patient and course of disease in a manner that correlates to clinical response.

Also provided herein are combinations and kits that contain an anti-hyaluronan agent, such as a hyaluronan-degrading enzyme (for example any provided herein below in Section E) and an improved HABP (for example any provided herein below in Section C), and optionally other accompanying reagents, for use in selecting, monitoring and/or treating HA-associated diseases and conditions, in particular cancer.

1. Hyaluronan Accumulation in Disease and Correlation to Prognosis

Hyaluronan (HA; also called hyaluronic acid or hyaluronate) is a linear glycosaminoglycan (GAG) polymer containing repeating N-acetylglucosamine and D-glucuronic acid disaccharide subunits via GlcUA-β1,3-GlcNAc-β1,4-linkages. Hyaluronan is synthesized by a class of hyaluronan synthases, HAS1, HAS2 and HAS3. These enzymes act by lengthening hyaluronan by adding glucuronic and N-acetylglucosamine to the nascent polysaccharide as it is extruded through the cell. In addition to the HA synthases, the level of HA normally is maintained by its catabolism by hyaluronidases, specifically the turnover enzyme hyaluronidase 1 (Hyal1). The dynamic turnover of HA is balanced by biosynthesis and catabolism to keep a constant concentration in the normal tissue.

HA is a component of the extracellular matrix (ECM). It is ubiquitously distributed in tissues and localized in the extracellular, pericellular matrices as well as inside cells. HA has a wide range of biological functions such as contributing to tissue homeostasis and biomechanics, cell proliferation, immune adhesion and activation, and cell migration during dynamic cellular processes. These processes are mediated by interaction of HA with HA-binding proteins known as hyaladherins, such as TSG-6, versican, inter-alpha-trypsin inhibitor, CD44, lymphatic vessel endothelial HA receptor (LYVE-1-1) and RHAMM.

Hyaluronan accumulation is associated with many malignant and autoimmune disease conditions (Järveläinen H, et al. (2009) *Pharmacol Rev* 61: 198-223; Whatcott C J, et al. (2011) *Cancer Discovery* 1:291-296). For example, certain diseases are associated with expression and/or production of hyaluronan, including inflammatory diseases and cancers. HA is linked to a variety of biological processes involved with progression of such diseases (see e.g. Itano et al. (2008) *Semin Cancer Biol* 18(4):268-274; Tammi et al. (2008) *Semin Cancer Biol* 18(4):288-295).

In particular, HA is a component of the tumor matrix and is present in many solid tumors. Accumulation of HA within a tumor focus prevents cell-cell contact, promotes epithelial-mesenchymal transitions, is involved with the p53 tumor suppressor pathway via its receptors RHAMM and CD44 and recruits tumor-associated macrophages (Itano et al. (2008) *Cancer Sci* 99: 1720-1725; Camenisch et al. (2000) *J Clin Invest* 106:349-360; Thompson et al. (2010) *Mol. Cancer Ther.* 9:3052-64). The assembly of a pericellular matrix rich in HA is a prerequisite for proliferation and migration of mesenchymal cells that can promote metastatic behavior. Tumors characterized by the accumulation of HA also exhibit tumor water uptake and have high interstitial fluid pressure (IFP) that can inhibit penetration of and accessibility of the tumor to systemically applied therapeutics, such as chemotherapeutics. Further, HA oligomers, generated by degradation by Hyal1, also have been shown to result in angiogenesis or apoptosis that can contribute to tumor pathogenesis.

The accumulation of HA has been correlated to HAS gene expression and/or HYAL gene expression (Kosaki et al. (1999) *Cancer Res.* 59:1141-1145; Liu et al. (2001) *Cancer Res.* 61:5207-5214; Wang et al. (2008) *PLoS* 3:3032; Nykopp et al. (2010) *BMC Cancer* 10:512). Studies in the art have variously shown that HA, HAS or Hyal1 can be used as prognostic indicators of cancer. Also, studies have suggested that the selective inhibition of Hyal1, such as by anti-sense methods, or of hyaluronan synthesis by HAS, such as by the use of 4-methylumbelliferone, are methods of treating tumors (Kakizaki et al. (2004) *J. Biol. Chem.* 279:33281-33289). In addition, hyaluronidases, such as PH20 as discussed below, also have been used to treat hyaluronan-associated diseases and conditions (see e.g. Thompson et al. (2010) *Mol. Cancer Ther* 9:3052-3064).

As shown in the Examples, it is now found herein that the HA phenotype of a cell, and in particular the formation of a tumor pericellular matrix, correlates to tumor aggressiveness, and that an assay for HA levels specifically predicts that ability of HA-synthesizing tumors cells to form a pericellular matrix. Specifically, it is found herein that among the potential markers of HA accumulation, including HAS1,2,3; Hyal1 or 2; or HA, that only HA determination correlated with pericellular matrix formation and thereby predicted tumor cell competence to form HA-aggrecan-mediated pericellular matrices and thereby tumor aggressiveness. Thus, for purposes of a diagnostic to predict or prognose tumor therapy, an HA binding protein (HABP) is contemplated. As described herein, tumor HA production can be measured quantitatively using an HABP as a probe, and HABP for hyaluronan shows a correlation to pericellular matrix formation while no correlation was found between pericellular matrix formation and relative levels of HAS or Hyal mRNA. These findings show that direct measurement of tumor cell-associated HA, and not the other markers involved in the HA metabolic pathway, offers a reliable predictor for pericellular matrix formation.

2. Therapy of Tumors with an Anti-Hyaluronan Agent (e.g. Hyaluronan-Degrading Enzyme) and Responsiveness to Treatment It also is found herein that the amount or extent of HA accumulation measured also correlates with responsiveness to treatment with an anti-hyaluronan agent, for example a hyaluronan-degrading enzyme, such as PH20. Anti-Hyaluronan agents, for example hyaluronan-degrading enzymes, such as a PH20, exhibit properties useful for single-agent or combination therapy of diseases and conditions that exhibit the accumulation of hyaluronan (hyaluronic acid, HA). Such hyaluronan-associated diseases, conditions and/or disorders include cancers and inflammatory diseases. Hyaluronan-rich cancers include, but are not limited to, tumors, including solid tumors, for example, late-stage cancers, a metastatic cancers, undifferentiated cancers, ovarian cancer, in situ carcinoma (ISC), squamous cell carcinoma (SCC), prostate cancer, pancreatic cancer, non-small cell lung cancer, breast cancer, colon cancer and other cancers.

For example, HA degrading enzymes, such a hyaluronidase, for example PH20, have been shown to remove HA from tumors resulting in the reduction of tumor volume, the reduction of IFP, the slowing of tumor cell proliferation, and the enhanced efficacy of co-administered chemotherapeutic drugs and biological agents by permitting increased tumor penetration (see e.g. U.S. published application No. 20100003238 and International published PCT Appl. No WO 2009/128917; Thompson et al. (2010) *Mol. Cancer. Ther* 9:3052-3064).

The ability of a hyaluronidase, such as PH20, to degrade HA to serve as a therapeutic of hyaluronan-associated diseases and disorders can be exploited by modification to increase systemic half-life. The increased half-life permits not only removal of HA, but also, due to its continued presence in the plasma and its ability to degrade HA, reduces or decreases the extent of regeneration of HA within diseased tissues, such as the tumor. Hence, maintenance of plasma enzyme levels can remove HA, such as tumor HA, and also counteract HA resynthesis. PEGylation is an established technology used to increase the half-life of therapeutic proteins in the body thus enabling their use in systemic treatment protocols. PEGylation of anti-hyaluronan agents, such as hyaluronan-degrading enzymes, such as hyaluronidase extends its half-life in the body from less than a minute to approximately 48 to 72 hours and allows for the systemic treatment of tumors rich in HA (see e.g. U.S. published application No. 20100003238 and International published PCT Appl. No WO 2009/128917; Thompson et al. (2010) *Mol Cancer Ther* 9: 3052-3064).

It is found herein that the growth inhibitory activity of an anti-hyaluronan agent, and in particular a hyaluronan-degrading enzyme, for example a hyaluronidase, such as a PH20 or PEGPH20, on tumor cells is correlated with the extent of HA levels. As shown in the Examples, tumors can be characterized into phenotypic groups (e.g. $HA^{+1}$, $HA^{+2}$, $HA^{+3}$) based on the amount of HA expression in the tumor. High tumor-associated HA (scored $HA^{+3}$) resulted in accelerated tumor growth in animal models and to greater tumor inhibition by a hyaluronan-degrading enzyme (e.g. PEGPH20). For example, tumor growth inhibition associated with an $HA^{+3}$ phenotype was 97%, whereas it was only 44% and 16% for tumor $HA^{+2}$ or $HA^{+1}$ phenotypes, respectively. The data indicate the continued growth of some tumors is dependent upon the density and amount of HA in the tumor microenvironment and that depletion of HA from an HA rich (e.g. $HA^{+3}$) tumor has a more pronounced effect on tumor growth than depletion of HA from an HA moderate or poor tumor (e.g., $HA^{+2}$, $HA^{+1}$) or HA deficient tumor. Thus, as shown herein, the degree of HA accumulation in tumor tissues, as measured using an HABP, is predictive of the level of inhibition of tumor growth in vivo mediated by an anti-hyaluronan agent (e.g., PEGPH20).

3. Hyaluronan Binding Proteins (HABPs) Reagent and Diagnostic

Based on the results provided above and in the Examples herein, the biomarker HA detected using an HABP has been specifically correlated to response to an anti-hyaluronan treatment, for example a hyaluronan-degrading enzyme treatment (e.g. PEGPH20). Thus, provided herein is a method of using an HABP for prognosis and also to predict the degree of sensitivity, and thus responsiveness, to an anti-hyaluronan agent, for example a hyaluronan-degrading enzyme (e.g. a hyaluronidase or modified hyaluronidase such as PEGylated PH20, i.e. PEGPH20).

For value as a reagent, the sensitivity and specificity of an HABP is desired as well as reproducibility due to low variability. For example, the detection and measurement of HA in tissues is limited using existing reagents. Currently, the method used to detect or measure HA in tissues via immunohistological staining is mainly dependent on the animal cartilage tissue-derived HA binding proteins or domains. These include the HABP purified from bovine nasal cartilage proteoglycan by extraction with 4 M guanidine HCl and then by affinity chromatography using HA coupled resin. The resulting animal-derived HA is composed of two major components: Aggrecan G1 domain and link module. Due to variation from batch to batch, as well as different modifications used in the method to prepare the HABP, variability exists in the art in terms of differences in the HABP staining patterns and the discrepancies in staining profiles make comparisons among studies difficult. Thus, due to its existence as a heterogenous mixture of components and no validated procedure for its production, alternative HABP proteins are provided herein for use in companion diagnostics for prognosis of disease and predicting efficacy of treatment in conjunction with an anti-hyaluronan agent (e.g. a hyaluronan-degrading enzyme).

Hence, the HABP reagent for use in the methods provided herein includes any HABP that is not an HABP purified from animal cartilage, for example, purified from bone nasal cartilage as used in the art using a method as described by E-Laurent et al. (1985) *Ann. Rheum. Dis.* 44:83-88) or modified method thereof. Exemplary HABPs for use in the methods herein are described in Section C. Such proteins include, for example, HABPs containing one or more HA binding domains, including one or more link modules for binding to HA. In some examples, the HABP contains an HA binding domain (e.g. a link module) of aggrecan, versican, neurocan, brevican, phosphacan, HAPLN-1, HAPLN-2, HAPLN-3, HAPLN-4, stabilin-1, stabilin-2, CAB61358, KIAA0527, or TSG-6 protein. In some examples, the HABP contains an aggrecan G1 domain, versican G1 domain, neurocan G1 domain, brevican G1 domain, or a phosphacan G1 domain. In some examples, the HABP contains a G1 domain of aggrecan, versican, neurocan, brevican, or phosphacan and a link protein selected from HAPLN-1, HAPLN-2, HAPLN-3, or HAPLN-4. In some examples, the HABP contains a link module of TSG-6, stabilin-1, stabilin-2, CAB61358, or KIAA0527.

In some examples, the HABP is a modified HABP, such as, for example a modified aggrecan, versican, neurocan, brevican, phosphacan, HAPLN-1, HAPLN-2, HAPLN-3, HAPLN-4, stabilin-1, stabilin-2, CAB61358, KIAA0527, or TSG-6 protein, such as, for example TSG-6-LM-Fc. In some examples, the HABP is a modified HABP that is modified to improve its binding to HA, such as, for example, TSG-6-LM-FcΔHep.

In particular, the HABP provided herein 1) can be produced recombinantly in an expression system, such as a mammalian expression system; 2) exhibits improved biophysical properties such as stability and/or solubility; 3) can be purified by simple purification methods, such as by one-step affinity purification methods; 4) is capable of being detected by procedures compatible with binding assays, and in particular immunohistochemistry or ELISA methods; 5) can be expressed in multimeric form (e.g. via dimerization) to exhibit increased or high affinity for HA; and/or 6) exhibits specificity for HA as compared to other GAGs.

In one example, provided herein for use in the methods herein are HABPs that are single module HA proteins that can be produced recombinantly in expression systems. In particular, provided herein are HABP reagents that contain a link module. For example, HABPs provided herein are of the type A class of HABPs containing only the link module (LM) or a sufficient portion thereof to bind to hyaluronan. Exemplary of such HABPs are tumor necrosis factor-stimulated Gene (TSG)-6-LM (link module set forth in SEQ ID NO:360), stabilin-1-LM or stabilin-2-LM (link module set forth in SEQ ID NO:371 or 372, respectively), CAB61358-LM (link module set forth in SEQ ID NO: 373) or KIAA0527-LM (link module set forth in SEQ ID NO:374).

In another example, provided herein for use in the methods herein are HABPs that are linked directly or indirectly to a multimerization domain. HA-binding domains, such as a link module, of HABPs can be directly or indirectly linked, such as covalently-linked, non-covalently-linked or chemically linked, to form multimers of two or more HA binding domains. The HA binding domains can be the same or different. In particular, the HA binding domain is a link domain or module. Hence, multimers can be formed by dimerization of two or more link domains. In one example, multimers can be linked by disulfide bonds formed between cysteine residues on different HA-link domains. For example, a multimerization domain can include a portion of an immunoglobulin molecule, such as a portion of an immunoglobulin constant region (Fc). In another example, multimers can include an HA-binding domain joined via covalent or non-covalent interactions to peptide moieties fused to the polypeptide. Such peptides can be peptide linkers (spacers), or peptides that have the property of promoting multimerization. In additional example, multimers can be formed between two polypeptides through chemical linkage, such as for example, by using heterobifunctional linkers. A description of multimerization domains is provided below. Exemplary of a HABP multimer is a link module (LM) fused to an Fc. For example, exemplary of an HABP reagent for use in the methods herein is TSG-6-LM-Fc.

In a further example, provided herein for use in the methods herein are HABP that are modified, such as by amino acid replacement, to exhibit increased specificity for hyaluronan compared to other GAGs. For example, provided herein is a mutant TSG-6-LM containing amino acid replacement(s) at amino acid residues 20, 34, 41, 54, 56, 72 and/or 84, and in particular at amino acid residues 20, 34, 41, and/or 54 (corresponding to amino acid residues set forth in SEQ ID NO:206). The replacement amino acid can be to any other amino acid residue, and generally is to a non-basic amino acid residue. For example, amino acid replacement can be to Asp (D), Glu (E), Ser (S), Thr (T), Asn (N), Gln (Q), Ala (A), Val (V), Ile (I), Leu (L), Met (M), Phe (F), Tyr (Y) or Trp (W). The amino acid replacement or replacements confer decreased binding to heparin. Binding can be reduced at least 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold or more compared to binding of TSG-6-LM to heparin not containing the amino acid replacement. Exemplary of a TSG-6-LM mutant for use as a reagent in the method provided herein is K20A/K34A/K41A. Hence, for example, binding to heparin is reduced such that specificity to hyaluronan is increased. The mutant TSG-6-LM can be conjugated directly or indirectly to a multimerization domain to generate multimers. For example, exemplary of a reagent for use in the methods herein is TSG-6-LM(K20A/K34A/K41A)-Fc.

Any of the reagents can be used alone or in combination in a companion diagnostic method. For example, in a sandwich ELISA or competitive ELISA, two or more of the above reagents can be used. As described herein below, any of the HABPs provided herein can be conjugated directly or indirectly to a moiety that is capable of detection. In some examples, the HABPs that bind to HA, for example in a tumor sample, can be detected using a secondary reagent, such as an antibody that binds to the HABP. In some examples, the HABPs are modified to permit detection of HA binding. For example, the HABPs can be conjugated to a detectable molecule that permits either direct detection or detection via secondary agents, such as antibodies that bind to the modified HABPs and are coupled to detectable proteins, such as fluorescent probes or detectable enzymes, such as horseradish peroxidase.

4. Companion Diagnostic and Prognostic Methods

The HABPs provided herein can be used either individually or in combination with diagnostic, prognostic or monitoring methods utilizing binding assays on various biological samples of patients having a hyaluronan-associated disease or condition or at risk or suspected of having a hyaluronan-associated disease or condition. For example, the HABPs can be used in assays on patients having a solid tumor or at risk of developing a solid tumor or other cancer. In particular examples, a TSG-6-LM, TSG-6-LM-Fc or variant or mutant thereof such as one that exhibits reduced binding to heparin and increased specificity for hyaluronan is used in the methods herein. The diagnostic and prognostic methods can be used in conjunction with therapy with a hyaluronan-degrading enzyme in order to classify and/or select patients for treatment or to alter or modify the course of treatment.

In exemplary methods provided herein, the diagnostic and prognostic methods are companion methods to therapy with an anti-hyaluronan agent, such as a hyaluronan-degrading enzyme, for example a hyaluronidase or modified hyaluronidase such as PH20 or PEGPH20. HA detection can inform treatment selection, initiation, dose customization or termination, and thus can serve to individualize treatment with an anti-hyaluronan agent, for example a hyaluronan-degrading enzyme.

For example, an HABP companion diagnostic method can be used to determine whether a subject who is predisposed to a hyaluronan-associated disease or condition (e.g. cancer) or who is suffering from a hyaluronan-associated disease or condition (e.g. cancer) will benefit from or is predicted to be responsive to receiving treatment with an anti-hyaluronan agent, such as a hyaluronan-degrading enzyme. In the method, the level of HA expression from samples from subjects predisposed or known to have a hyaluronan-associated disease or condition (e.g. cancer) can be determined and the level of HA expression in samples from subjects compared to predetermined HA levels that classify responsiveness to an anti-hyaluronan agent, for example a hyaluronan-degrading enzyme. It is within the level of one of skill in the art to determine the threshold level of HA for classifying responsiveness to treatment with a hyaluronan-degrading enzyme. For example, it is found herein that a significant correlation exists between elevated HA accumulation and tumor growth inhibition, whereby tumor growth inhibition response is correlated to an $HA^{+3}$ phenotype as quantified by immunohistochemistry of tumor tissue. Thus, in the companion diagnostic method provided herein, a tumor sample is assessed for HA levels using an HABP reagent provided herein by immunohistochemistry methods or other methods adaptable to scoring. If the HA phenotype is $HA^{+3}$ as determined by methods known to one of skill in the art and described herein, then the subject is selected as a candidate for treatment with a hyaluronan-degrading enzyme, such as a hyaluronidase or modified hyaluronidase (e.g. PH20 or PEGPH20). Similar quantification and classification methods can be utilized by assessing HA in bodily fluids, such as blood or plasma. Dosages and regimens of a hyaluronan-degrading enzyme, such as PH20 or PEGPH20, for treatment are provided herein.

The HABP reagents provided herein can detect HA using any binding assay known to one of skill in the art including, but not limited to, enzyme linked immunosorbent assay (ELISA) or other similar immunoassay, including a sandwich ELISA or competitive ELISA assay; immunohistochemistry (IHC); flow cytometry, or western blot. The binding assay can be performed on samples obtained from a patient body fluid, cell or tissue sample of any type, including from plasma, urine, tumor or suspected tumor tissues (including fresh, frozen, and fixed or paraffin embedded tissue), lymph node tissue or bone marrow.

Once the amount of HA in the sample is determined, the amount can be compared to a control or threshold level. For example, if the amount of HA is determined to be elevated in the sample, the subject is selected as a candidate for tumor therapy. Exemplary methods for stratification of tumor samples or bodily fluid samples for diagnosis, prognosis or selection of subjects for treatment are provided herein.

In one example, a method of diagnosis utilizes a sample of tumor tissue, tumor cells or a bodily fluid containing proteins from a patient. In the method, the presence and level of expression of HA can be determined using an HABP, for example a TSG-6-LM, TSG-6-LM-Fc or variant or mutant thereof, as provided herein. The level of expression of the HA is determined and/or scored and compared to predetermined HA phenotypes associated with disease. As described below, these predetermined values can be determined by comparison or knowledge of HA levels in a corresponding normal sample as determined by the same assay of detection and using the same HABP reagent. It is within the level of one of skill in the art to determine the threshold level for disease diagnosis depending on the particular disease, the assay being used for detection of HA and/or the HABP detection reagent being used. For example, in bodily fluids such as plasma, HA levels greater than 0.015 μg/mL, and generally greater than 0.02 μg/mL, 0.03 μg/mL, 0.04 μg/mL, 0.05 μg/mL, 0.06 μg/mL or higher correlates to the presence of a tumor or cancer. In another example, in immunohistochemistry methods of tumor tissues with a score of $HA^{+2}$ or $HA^{+3}$ can be determinative of disease. If the level is indicative of disease, then the patient is diagnosed with having a tumor.

In another example, a prognostic method utilizes a sample of tumor tissue, tumor cells or a bodily fluid containing proteins from a patient. In the method, the presence and level of expression of HA can be determined using an HABP, for example a TSG-6-LM, TSG-6-LM-Fc or variant or mutant thereof, as provided herein. The level of expression of the HA is determined and/or scored and compared to predetermined HA phenotypes associated with disease. As described below, these predetermined values can be determined by comparison or knowledge of HA levels in a corresponding normal sample or samples of disease subjects as determined by the same assay of detection and using the same HABP reagent. It is within the level of one of skill in the art to determine the threshold levels for prognosis of disease depending on the particular disease, the assay being used for detection of HA and/or the HABP detection reagent being used. The level of expression of HA indicates the expected course of disease progression in the patient. For example, high levels of HA as assessed by immunohistochemistry methods using a quantitative score scheme (e.g., $HA^{+3}$) correlate to the existence of malignant disease across a range of cancer types. In another example, HA levels in bodily fluid such as plasma of greater than 0.06 μg/mL HA also is associated with advanced disease stage.

In a further example of companion diagnostic methods, the level of HA expression in samples from subjects previously treated with a hyaluronan-degrading enzyme can be monitored to determine whether a subject being administered the agent has obtained an efficacious blood level of the drug in order to optimize dosing or scheduling.

The following sections describe exemplary HABP reagents and assays for performing the HA detection methods for use in the diagnostic and prognostic methods, and in particular as companions to therapy with an anti-hyaluronan agent, for example a hyaluronan-degrading enzyme. Also described are anti-hyaluronan agents, including hyaluronan-degrading enzyme agents, for use in treating hyaluronan-associated diseases and disorders and kits and combinations of HABP reagents with such agents (e.g. hyaluronan-degrading enzymes). Any of the above methods can be performed using any of the described HABP reagents and assay detection methods alone or in conjunction with therapy with an anti-hyaluronan agent (e.g. a hyaluronan-degrading enzyme).

C. HYALURONAN BINDING PROTEINS (HABPS) FOR USE AS A COMPANION DIAGNOSTIC

The methods provided herein are directed to quantitative or semi-quantitative measurement of hyaluronan in a sample, such as a tumor or fluid sample from a subject having a tumor or suspected of having a tumor, using a hyaluronan binding protein (HABP). As described herein, tumors that express elevated or high levels of hyaluronan are responsive to treatment with an anti-hyaluronan agent (e.g. hyaluronan degrading enzyme) and the degree of tumor inhibition by an anti-hyaluronan agent (e.g. hyaluronan degrading enzyme) correlates with the degree or amount of hyaluronan accumulation, and not other markers such as expression of endogenous hyaluronan synthases or hyaluronidases. The HABPs provided for use in the methods herein, in concert with the assays for detection thereof described in Section D, permit specific and sensitive detection of HA in samples.

The HABP companion diagnostics provided herein can be used in conjunction with therapy with an anti-hyaluronan agent, such as hyaluronan-degrading enzyme therapeutics or any described in Section E, to select or identify patients predicted to be responsive to treatment and/or to monitor treatment and efficacy of treatment, thereby providing an improved treatment regimen of hyaluronan-associated diseases or conditions. For example, the HABP companion diagnostics provided herein can be used to select and/or monitor subjects or patients having a tumor or cancer. In addition, the HABP companion diagnostics also can be used in other diagnostic and prognostic methods of hyaluronan-associated disease or conditions, such as tumors or cancers.

Provided herein are hyaluronan binding proteins for use in the methods provided herein for the detection and quantitation of hyaluronan in a sample. The hyaluronan binding proteins can contain full length HABP polypeptides, or portions thereof containing HA binding domains of HABPs, or sufficient portions thereof to bind HA. Typically, the HABPs or portions thereof containing an HA binding domain or sufficient portion thereof that binds HA, or variants or multimers thereof exhibit a binding affinity with a dissociation constant (Kd) of at least less than or less than or $1\times10^{-7}$ M, and generally at least less than or less than or $9\times10^{-8}$ M, $8\times10^{-8}$ M, $7\times10^{-8}$ M, $6\times10^{-8}$ M, $5\times10^{-8}$ M, $4\times10^{-8}$ M, $3\times10^{-8}$ M, $2\times10^{-8}$ M, $1\times10^{-8}$ M, $9\times10^{-9}$ M, $8\times10^{-9}$ M, $7\times10^{-9}$ M, $6\times10^{-9}$ M, $5\times10^{-9}$ M, $4\times10^{-9}$ M, $3\times10^{-9}$ M, $2\times10^{-9}$ M, $1\times10^{-9}$ M or lower Kd. As discussed herein, the exhibited binding affinity is generally exhibited under conditions that achieve optimal or close to optimal binding to hyaluronan. In one example, pH conditions can affect binding. For example, as a companion diagnostic herein, binding assays using a TSG-6 reagent, including TSG-6-LM or sufficient portions thereof to bind HA, variants thereof and multimers thereof, are generally conducted at a pH of at or about between pH 5.8 to 6.4, such as about or pH 6.0.

Hyaluronan binding proteins are of two types: hyaluronan binding proteins that have an HA binding domain that contains one or two link modules, and hyaluronan binding proteins that have an HA binding domain that is not a link module. In particular examples, the companion diagnostics provided herein are derived from HABP binding molecules that have only a single link domain that confers HA binding, which can simplify expression, production and purification methods.

The HABPs provided herein can be derived from known HABPs or can be generated synthetically. In some examples, HABPs can be generated synthetically based on conserved residues of HA-binding domains of known HABPs. HABPs provided herein also can be derived from HABPs generated from screening methods for HA binding proteins, such as phage display or affinity-based screening methods.

The HABPs, including HA binding domains of HABPs, or portions thereof that are sufficient to bind to HA, provided herein can be modified to improve one or more properties of HABPs for use in the methods provided herein. For example, the HABPs, or HA binding fragments thereof, provided herein can be modified to increase protein expression in mammalian expression systems, improve biophysical properties such as stability and solubility, improve protein purification and detection, increase specificity for HA and/or increase affinity to HA, as long as they retain their ability to bind to HA. For example, an HABP or HA binding fragment thereof provided herein for use in the methods can be modified to increase its specificity for hyaluronan compared to other glycosaminoglycans. In another example, an HABP or HA binding fragment thereof provided herein for use in the methods can be linked directly or indirectly to a multimerization domain to increase the number of HA binding sites on the molecule and therefore increase the affinity for binding to HA.

Further, for use as a companion diagnostic herein, any of the HABPs, or portions thereof (e.g. link modules or sufficient portions thereof to bind HA) can be modified to facilitate detection. For example, the companion diagnostics are modified by conjugation, directly or indirectly, to biotin, a fluorescent moiety, a radiolabel or other detectable label.

A description of exemplary HABPs for use as companion diagnostics herein, and modifications thereof, is provided below.

1. HA Binding Proteins with Link Modules or G1 Domains

Provided herein as companion diagnostic reagents for use in the methods herein are HA binding proteins (HABP) or portions thereof that contain at least one link module or link domain, and generally at least two or more link modules. In some examples, the HABP contains a G1 domain that contains two link modules. Binding to HA is mediated via the link module. Link modules, also called proteoglycan tandem repeats, are approximately 100 amino acids (aa) in length with four cysteines that are disulfide bonded in the pattern Cys1-Cys4 and Cys2-Cys3. The three dimensional structure of the link modules are composed of two alpha-helices and two triple stranded anti-parallel beta-sheets.

There are three categories of link module-containing proteins: A domain-type proteins that contain a single link module; B domain-type proteins that contain a single link module extended by an N- and a C-terminal flanking region; and C domain-type proteins that have an extended structure called a G1 domain that contains one N-terminal V-type Ig-like domain followed by a contiguous pair of two link modules. Modeling and comparison studies have demonstrated a high degree of resolution and conservation of certain amino acids between and among link module-containing proteins that correlate to interaction with HA (Blundell et al. (2005) *J. Biol. Chem.,* 280:18189-18201). For example, central HA-binding amino acid residues corresponding to Tyr59 and Tyr78 with numbering with reference to TSG-6-LM set forth in SEQ ID NO:360 are conserved among link-module-containing HABPs via identical or conservative amino acids (e.g. aromatic or large and planar faced hydrophobic residues that can also stack against a GlcNAc ring, e.g., Phe, His, Leu or Val) at the corresponding position based on alignment with TSG-6-LM (e.g. set forth in SEQ ID NO:360). Also, basic residues at positions corresponding to positions 11 and 81 set forth in SEQ ID NO:360 also are found in other link modules as determined by alignment.

HA binding proteins containing link modules for use in the methods provided herein include, but are not limited to, TSG-6 (e.g. set forth in SEQ ID NO: 206 as the precursor and in SEQ ID NO:222 as the mature protein lacking a signal sequence; or the LM set forth in SEQ ID NO:207, 360, 417 or 418, which represent various lengths of the LM as reported in the literature), stabilin-1 (e.g. set forth in SEQ ID NO:223 or the mature form thereof; or the LM set forth in SEQ ID NO:371), stabilin-2 (e.g. set forth in SEQ ID NO:224 or the mature form thereof; or the LM set forth in SEQ ID NO:372), CD44 (e.g. set forth in SEQ ID NO:227 or the mature form thereof; or the LM set forth in SEQ ID NO:375), LYVE-1 (e.g. set forth in SEQ ID NO:228 or the mature form thereof; or the link module set forth in SEQ ID NO:376), HAPLN1 (e.g. HAPLN1-1 and HAPLN1-2; e.g., set forth in SEQ ID NO:229 or the mature form thereof; or the LM or LMs set forth in SEQ ID NO:377 or 378), HAPLN2 (e.g. HAPLN2-1 and HAPLN2-2; e.g. set forth in SEQ ID NO:230 or the mature form thereof; or the LM or LMs set forth in SEQ ID NO: 379 or 380), HAPLN3 (e.g. HAPLN3-1 and HAPLN3-2; e.g. set forth in SEQ ID NO:231 or the mature form thereof; or the LM or LMs set forth in SEQ ID NO:381 or 382), HAPLN4 (e.g. HAPLN4-1 and HAPLN4-2; e.g. set forth in SEQ ID NO:232 or the mature form thereof; or the LM or LMs set forth in SEQ ID NO:383 or 384), aggrecan (e.g. aggrecan 1, aggrecan 2, aggrecan 3 and aggrecan 4; e.g. set forth in SEQ ID NO:233 or the mature form thereof; or the LM or LMs set forth in SEQ ID NO: 385, 386, 387 or 388), versican (e.g. versican 1 and versican 2; e.g. set forth in SEQ ID NO:235 or the mature form thereof; or the LM or LMs set forth in SEQ ID NO:391 or 392), brevican (e.g. brevican 1 and brevican 2; e.g. set forth in SEQ ID NO:234 or the mature form thereof; or the LM or LMs set forth in SEQ ID NO:389 or 390), neurocan (e.g. neurocan 1 and neurocan 2; e.g. set forth in SEQ ID NO:236 or the mature form thereof; e.g. the LM or LMs set forth in SEQ ID NO:393 or 394) and phosphacan (e.g. set forth in SEQ ID NO:340 or the mature form thereof). Exemplary of an HABP provided for use in the methods herein is TSG-6.

In particular examples herein, the HABP used in the methods herein contains at least one link module, and in some cases contains at least two or at least three link modules. The HABP can be a full-length HABP containing a link module. For example, the companion diagnostic reagent for use in the method herein can contain a sequence of amino acids set forth in any of SEQ ID NOS:206, and 223-236, the mature form thereof, or a sequence of amino acids that exhibits at least 65%, 70%, 75%, 80%, 84%, 90%, 91%, 92%, 93%, 94%, 95%, 96%, 97%, 98%, or 99% sequence identity to a sequence set forth in any of SEQ ID NOS: 206, and 223-236. For example, the HABP for use as a companion diagnostic herein can be a full-length TSG-6 having the sequence of amino acids set forth in SEQ ID NO:222, or a sequence of amino acids that exhibits at least 65%, 70%, 75%, 80%, 84%, 90%, 91%, 92%, 93%, 94%, 95%, 96%, 97%, 98%, or 99% sequence identity to a sequence set forth in SEQ ID NO:222.

In other examples, the companion diagnostic reagent for use in the methods herein contains only the link module or sufficient portion of a link module to bind to HA derived from a full-length HABP set forth in any of SEQ ID NOS: 206, and 223-236 or the mature form thereof (lacking the signal sequence). In some examples, the HABP containing a link module or modules is not the complete sequence of an HABP set forth in any of SEQ ID NOS: 206, and 223-236 or the mature form thereof (lacking the signal sequence). It is understood that the portion of an HABP or link module is generally a contiguous sequence of amino acids that is generally at least 50 amino acids in length, 60, 70, 80, 90, 100, 200, 300 or more amino acids. In some examples, the link module or modules is the only HABP portion of the companion diagnostic binding molecule. For example, the companion diagnostic reagent for use in the method herein contains only a portion of a full-length HABP and has a sequence of amino acids set forth in any of SEQ ID NOS:207, 360, 361, 371-394 and 416-418 or a sequence of amino acids that exhibits at least 65%, 70%, 75%, 80%, 84%, 90%, 91%, 92%, 93%, 94%, 95%, 96%, 97%, 98%, or 99% sequence identity to a sequence set forth in any of SEQ ID NOS: 207, 360, 361, 371-394 and 416-418.

In examples herein, the companion diagnostic reagent for use in the methods herein contains a G1 domain or sufficient portion thereof to bind to specifically bind to HA. The HABP containing the G1 domain can be derived from a full-length HABP set forth in any of SEQ ID NOS: 233-236 or the mature form thereof. In some examples, the HABP containing the G1 domain is not the complete sequence of an HABP set forth in any of SEQ ID NOS:233-236 or mature form thereof. It is understood that the portion of an HABP containing a G1 domain is generally a contiguous sequence of amino acids that is generally at least 100 amino acids in length, such as 150, 200, 250, 300, 400, or more amino acids. In some examples, the G1 domain is the only HABP portion of the companion diagnostic binding molecule. For example, the companion diagnostic reagent for use in the method herein contains only a portion of a full-length HABP and has a G1 domain having a sequence of amino acids set forth in any of SEQ ID NOS: 423-426 or a sequence of amino acids that exhibits at least 65%, 70%, 75%, 80%, 84%, 90%, 91%, 92%, 93%, 94%, 95%, 96%, 97%, 98%, or 99% sequence identity to a sequence set forth in any of SEQ ID NOS: 423-426.

In some examples, the companion diagnostic can contain more than one link module, such as two or three link modules. The link modules can be from the same or different HABP. The companion diagnostics can contain link modules that are linked directly or indirectly to form a single polypeptide. In other examples, the companion diagnostics can contain link modules that are set forth as separate polypeptides that are chemically linked, such as via a disulfide bond. Exemplary of an HABP fragment provided for use in the methods herein is the link domain of TSG-6 (TSG-6-LM), or a portion thereof sufficient to bind to HA.

In some examples, the HABP is a multimer containing two or more link modules that are linked directly or indirectly via a multimerization domain to effect the formation of dimer or trimer molecules and the generation of multiple HA binding sites. For example, a companion diagnostic for use in the methods herein is one that is generated by expression of a nucleic acid molecule encoding the link module set forth in any one of SEQ ID NOS: 207, 360, 361, 371-394 and 416-418 or a sequence of amino acids that exhibits at least 65%, 70%, 75%, 80%, 84%, 90%, 91%, 92%, 93%, 94%, 95%, 96%, 97%, 98%, or 99% sequence identity to a sequence set forth in any of SEQ ID NOS: 207, 360, 361, 371-394 and 416-418 linked directly or indirectly to a nucleic acid encoding a multimerization domain, such as an Fc portion of an immunoglobulin. Hence, the resulting HABP multimer or LM-multimer contains a first polypeptide set forth in any one of SEQ ID NOS: 207, 360, 361, 371-394 and 416-418 or a sequence of amino acids that exhibits at least 65%, 70%, 75%, 80%, 84%, 90%, 91%, 92%, 93%, 94%, 95%, 96%, 97%, 98%, or 99% sequence identity to a sequence set forth in any of SEQ ID NOS: 207, 360, 361, 371-394 and 416-418 linked directly or indirectly to a multimerization domain; and a second polypeptide set forth in any one of SEQ ID NOS: 207, 360, 361, 371-394 and 416-418 or a sequence of amino acids that exhibits at least 65%, 70%, 75%, 80%, 84%, 90%, 91%, 92%, 93%, 94%, 95%, 96%, 97%, 98%, or 99% sequence identity to a sequence set forth in any of SEQ ID NOS: 207, 360, 361, 371-394 and 416-418 linked directly or indirectly to a multimerization domain. The sequence of the link module in the first and second polypeptide can be the same or different. Exemplary of an HABP multimer provided for use in the methods herein is a multimer containing two polypeptide chains, whereby each contains the TSG-6-LM, variant thereof or sufficient portion thereof to bind HA linked directly or indirectly to a multimerization domain that effects multimerization. For example, provided herein for use in the methods is a TSG-6-LM:Fc molecule (see e.g. SEQ ID NO:212 or 215).

A description of exemplary HABPs containing link domains, including structure and function description, is provided below. Any of the described HABPs or portions thereof, such as a fragment containing only a link domain or sufficient portion thereof to bind HA, can be used as a companion diagnostic reagent in the methods herein. It is understood that reference to amino acids, including to a specific sequence set forth as a SEQ ID NO used to describe domain organization of a link domain or other domain are for illustrative purposes and are not meant to limit the scope of the embodiments provided. It is understood that polypeptides and the description of domains thereof are theoretically derived based on homology analysis and alignments with similar molecules. Thus, the exact locus can vary, and is not necessarily the same for each HABP. Hence, the specific domain, such as specific link domain, can be several amino acids (one, two, three or four) longer or shorter.

a. Type A: TSG-6 Sub-Group

Provided herein as a companion diagnostic for use in the methods herein are HABPs that are members of the Type A sub-group that contain a single link module that binds to hyaluronan. Type A HABPs bind to HA with a minimum chain length of six sugars, hexasaccharide ($HA_6$), or greater. Members of the Type A sub-group that can be used as companion diagnostics in the methods provided herein include, but are not limited to, TSG-6, Stabilin-1, Stabilin-2, CAB61358 and KIAA0527, link modules thereof, or sufficient portions of a link module that binds HA.

i. TSG-6

Exemplary of a Type A sub-group HABP provided for use as a companion diagnostic reagent in the methods provided herein is TSG-6, or a link module thereof, a sufficient portion of a link module to bind to HA, variants thereof or multimers thereof. Tumor necrosis factor-Stimulated Gene-6 (TSG-6, tumor necrosis factor alpha-induced protein 6, TNFAIP6; SEQ ID NO:206) is a ~35 kDa secreted glycoprotein composed of a single N-terminal link module and C-terminal CUB domain. Expression of TSG-6 is induced in many cell types by inflammatory mediators, including cytokines and growths factors. Via its link module, TSG-6 is a potent inhibitor of polymorphonuclear leukocyte migration. TSG-6 forms a stable complex with the serine protease inhibitor Inter-alpha-Inhibitor (IαI) and potentiates the anti-plasmin activity of IαI. TSG-6 also is important for the formation and remodeling of HA-rich pericellular coats and extracellular matrices.

The human TSG-6 transcript (SEQ ID NO:205) is normally translated to form a 277 amino acid precursor peptide (SEQ ID NO:206) containing a 17 amino acid signal sequence at the N-terminus. The mature TSG-6 (set forth in SEQ ID NO:222), therefore, is a 260 amino acid protein containing amino acids 18-277 of SEQ ID NO:206 (Lee et al. 1992) *J Cell Biol* 116:545-557). TSG-6 is composed of two main domains, the link module and the CUB domain. The link module of TSG-6 is variously reported in the literature to be located at amino acids 35-129, 36-128, 36-129 or 36-132 of SEQ ID NO:206 (set forth as SEQ ID NOS: 207, 360, 417 or 418, respectively). It is understood that reference to loci of a domain can vary by several amino acids due to differences in alignments. Hence, for purposes herein, a TSG-6-LM is one set forth in any of SEQ ID NOS: 207, 360, 417 or 418 or that varies from such sequence by one, two or three amino acids. The CUB domain is located at amino acids 135-246 of SEQ ID NO:206. Human TSG-6 has two potential N-linked glycans at residues N118 and N258 of SEQ ID NO:206. In addition, residues T259 and T262 of SEQ ID NO:206 are phosphorylated (Molina et al. (2007) *Proc Natl Acad Sci USA* 104:2199-2204). Human TSG-6 has eight native cysteines which form four disulfide bonds at residues C58-C127, C82-C103, C135-C161 and C188-C210 of preprotein TSG-6 (SEQ ID NO:206).

TSG-6 link module (SEQ ID NO:360) has a relatively small size and a well-characterized structure. The three dimensional structure of the TSG-6 link domain was determined and found to have the same fold as other known link modules, containing two alpha helices and two antiparallel beta sheets arranged around a large hydrophobic core (Kohda et al. (1996) *Cell* 86:767-775). In addition, the interaction of the link module of TSG-6 and HA has been studied revealing that the aromatic rings of Tyr12, Tyr59, Phe70, Tyr78, Trp88 and basic residues Lys11, Lys72, Asp77, Arg 81, and Glu86 of the link domain of TSG-6 (SEQ ID NO:360) are important for binding to HA (see, e.g., Kahmann et al. 2000) *Structure* 8:763-774; Mahoney et al. (2001) *J Biol Chem* 276:22764-22771; Kohda et al. (1996) *Cell,* 88:767-775; Blundell et al. (2003) *J Biol Chem* 278:49261-49270; Lesley et al. (2004) *J Biol Chem* 279:25745-25754; Blundell et al. (2005) *J Biol Chem* 280:18189-18201). Structural studies also show that there is only a single HA-binding site contained in the link module, which is localized to one region of the molecule based on the structural map of residues Lys11, Tyr12, Tyr59, Phe70 and Tyr78 that are most directly implicated in HA binding (see e.g. Mahoney et al. (2001) *J Biol Chem* 276: 22764-22771).

The link module of TSG-6 exhibits binding activity to several glycosaminoglycans. For example, studies have revealed binding of the link module to HA, chondroitin-4-sulphate (C4S), G1-domain of the proteoglycan aggrecan, heparin and the bikunin chain of IαI (see e.g., Milner et al. (2003) *Journal of Cell Science,* 116:1863-1873; Mahoney et al. (2005) *Journal of Biological Chemistry,* 280:27044-27055). The binding of TSG-6 to heparin and HA is mediated by a distinct binding site in the LM of TSG-6. The residues involved in TSG-6-LM binding to hyaluronan are Lys 11, Tyr12, Tyr59, Phe70 and Tyr78, whereby the mutants K11Q, Y12F, Y59F, F70V and Y78F have between 10- and 100-fold lower HA-binding affinity compared to wildtype; the residues in the TSG-6-LM involved in binding to heparin are Lys20, Lys34, Lys41, Lys54, Arg56 and Arg84, whereby the mutants K20A, K34A, K41A and K54A exhibit impaired heparin binding properties; and the residues involved in TSG-6-LM binding to bikunin is overlapping with but not identical to the HA binding site (Mahoney et al. (2005) *Journal of Biological Chemistry,* 280:27044-27055).

Binding of TSG-6 to hyaluronan is pH dependent, with binding activity exhibited at acidic pH of about or pH 5.6 to 6.4, such as or about pH 5.8 to pH 6.0.

TSG-6 polypeptides, HA binding domains thereof, e.g., TSG-6 link modules, or fragments thereof sufficient to bind to HA provided herein for use as a companion diagnostic in the in the methods herein can include any of SEQ ID NOS: 206, 207, 222, 360, 417 or 418, or variants thereof such as variants that exhibit at least 65%, 70%, 75%, 80%, 85%, 90%, 91%, 92%, 93%, 94%, 95%, 96%, 97%, 98%, 99% or more sequence identity to any one of SEQ ID NOS: 206, 207, 222, 360, 417 or 418. Exemplary variants include, for example, species variants, allelic variants and variants that contain conservative and non-conservative amino acid mutations. Natural allelic variants of human TSG-6 include, for example, TSG-6 containing the amino acid replacement Q144R (SEQ ID NO:407, Nentwich et al. (2002) *J Biol Chem* 277:15354-15362). TSG-6 is highly conserved among species with mouse and human protein being >94% identical. Species variants of TSG-6 or HA binding fragments thereof for use as a companion diagnostic in the methods provided herein also include, but are not limited to, mouse (SEQ ID NO:252), rabbit (SEQ ID NO:253), bovine (SEQ ID NO:254), horse (SEQ ID NO:409), chimpanzee (SEQ ID NO:408), dog (SEQ ID NO:410), mouse (SEQ ID NO:411), chicken (SEQ ID NO:412), frog *Xenopus laevis* (SEQ ID NO:413), zebra fish (SEQ ID NO:414), mature forms thereof or link modules or sufficient portions thereof to bind HA.

Variants of TSG-6 or HA binding fragments thereof for use in the provided methods include variants with an amino acid modification that is an amino acid replacement (substitution), deletion or insertion. Exemplary modifications are amino acid replacements such as an amino acid replacement at any of amino acid residues 4, 6, 8, 13, 20, 29, 34, 41, 45, 54, 67, 72 or 96 corresponding to residues in the TSG-6 set forth in SEQ ID NO: 360, 417 or 418. The replacement amino acid can be any other amino acid residue. Exemplary amino acid replacements of TSG-6 polypeptides or HA binding fragments thereof provided herein for use as a companion diagnostic reagent in the methods provided herein include modified TSG-6 polypeptides or HA-binding fragments thereof that contain at least one amino acid replacement corresponding to H4K, H4S, E6A, E6K, R8A, K13A, K20A, H29K, K34A, K41A, H45K, K54A, N67L, N67S, K72A, H96K, K34A/K54A or K20A/K34A/K41A corresponding to residues in the TSG-6 set forth in SEQ ID NO: 360, 417 or 418 (see, e.g., Mahoney et al. (2005) *J Biol Chem* 280:27044-27055, Blundell et al. (2007) *J Biol Chem* 282:12976-12988, Lesley et al. (2004) *J Biol Chem* 279:25745-25754, Kahmann et al. (2000) *Structure* 15:763-774). It is understood that residues important or otherwise required for the binding of TSG-6 to HA, such as any described above or known to one of skill in the art, are generally invariant and cannot be changed. Thus, for example, amino acid residues 11, 12, 59, 70, 78 and 81 of SEQ ID NO: 360 in the link module of TSG-6 are generally invariant and are not altered. Further, it is understood that amino acid modifications that result in improper folding or perturbation of the folding of the link module are generally invariant. Thus, for example, a modified TSG-6 provided for use in the methods herein will not contain any one or more of the amino acid modifications H4S, H29A, H45A, H45K, R56A, D77A, R84A and D89A of SEQ ID NO:360 (Mahoney et al. (2005) *J Biol Chem* 280:27044-27055, Blundell et al. (2007) *J Biol Chem* 282:12976-12988, Lesley et al. (2004) *J Biol Chem* 279:25745-25754).

In particular, the modification, for example amino acid replacement or replacements, is one that confers an altered, such as improved, activity compared to a TSG-6 not containing the modification. Such variants include those that contain amino acid modifications that enhance the binding affinity of TSG-6 to HA, increase the specificity of TSG-6 for HA, and/or increase the solubility of TSG-6. For example provided herein for use in the methods herein are TSG-6 variants, HA binding domains, or portions thereof sufficient to bind to HA that increase the specificity of TSG-6 for HA by decreasing the binding of TSG-6 to other glycosaminoglycans, including heparin, chondroitin-4-sulfate, heparan sulfate and dermatan sulfate. Binding to the other glycosaminoglycan that is not hyaluronan can be reduced at least 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold or more compared to binding of TSG-6-LM not containing the modification. For example, provided herein is a mutant TSG-6-LM containing amino acid replacement(s) at amino acid residues 20, 34, 41, 54, 56, 72 and/or 84, and in particular at amino acid residues 20, 34, 41, and/or 54 (corresponding to amino acid residues set forth in SEQ ID NO:206). The replacement amino acid can be to any other amino acid residue, and generally is to a non-basic amino acid residue. For example, amino acid replacement can be to Asp (D), Glu (E), Ser (S), Thr (T), Asn (N), Gln (Q), Ala (A), Val (V), Ile (I), Leu (L), Met (M), Phe (F), Tyr (Y) or Trp (W). The amino acid replacement or replacements confer decreased binding to heparin. For example, variants that decrease the ability of TSG-6 to bind to heparin are known to one of skill in the art. Such variants are those that include at least one mutation corresponding to K20A, K34A, K41A and K54A, including variants K34A/K54A or K20A/K34A/K41A (Mahoney et al. (2005) *J Biol Chem* 280:27044-27055). Exemplary variants that decrease or reduce binding to heparin are variant TSG-6-LM set forth in SEQ ID NO:361 or 416.

Exemplary of a TSG-6 polypeptide provided herein for use in the methods provided herein is a TSG-6 polypeptide that contains at least an HA binding domain, for example, a TSG-6 link module. Thus, provided herein is a TSG-6 link module, or variant thereof, for use in the provided methods. Exemplary of such a polypeptide reagent is one that has a sequence of amino acids set forth in SEQ ID NO: 207, 360, 361, 416, 417 or 418, or has a sequence of amino acids that exhibits at least 65%, 70%, 75%, 80%, 85%, 90%, 91%, 92%, 93%, 94%, 95%, 96%, 97%, 95%, 99% or more sequence identity to any of SEQ ID NOS: 207, 360, 361, 416, 417 or 418. For example, the TSG-6 link module can be modified to alter its specificity, affinity or solubility, as long as it retains its ability to bind to HA.

In yet another example, the affinity of the TSG-6 link module is increased by dimerization or multimerization, such as, for example, by fusion to a multimerization domain, such as an Fc domain (see Section C3 below). Hence, the TSG-6 link module can be modified to produce a multimer containing two or more link modules that are linked directly or indirectly via a multimerization domain to effect the formation of dimer or trimer molecules and the generation of multiple HA binding sites. For example, a companion diagnostic for use in the methods herein is one that is generated by expression of a nucleic acid molecule encoding the link module set forth in any one of SEQ ID NOS: 207, 360, 361, 417 or 418 or a nucleic acid encoding a link module having a sequence of amino acids that exhibits at least 65%, 70%, 75%, 80%, 84%, 90%, 91%, 92%, 93%, 94%, 95%, 96%, 97%, 98%, or 99% sequence identity to a sequence set forth in any of SEQ ID NOS: 207, 360, 361, 417 or 418 linked directly or indirectly to a nucleic acid encoding a multimerization domain, such as an Fc portion of an immunoglobulin. Hence, the resulting TSG-6-LM multimer contains a first polypeptide set forth in any one of SEQ ID NOS: 207, 360, 361, 417 or 418 or a sequence of amino acids that exhibits at least 65%, 70%, 75%, 80%, 84%, 90%, 91%, 92%, 93%, 94%, 95%, 96%, 97%, 98%, or 99% sequence identity to a sequence set forth in any of SEQ ID NOS: 207, 360, 361, 417 or 418 linked directly or indirectly to a multimerization domain; and a second polypeptide set forth in any one of SEQ ID NOS: 207, 360, 361, 417 or 418 or a sequence of amino acids that exhibits at least 65%, 70%, 75%, 80%, 84%, 90%, 91%, 92%, 93%, 94%, 95%, 96%, 97%, 98%, or 99% sequence identity to a sequence set forth in any of SEQ ID NOS: 207, 360, 361, 417 or 418 linked directly or indirectly to a multimerization domain. Generally, the LM or sufficient portion thereof to effect HA binding is the only TSG-6 portion of the multimer. For example, provided herein for use in the methods is a TSG-6-LM:Fc molecule (see e.g. SEQ ID NO:212 or 215).

In another example, the TSG-6 link module is linked to a Fc domain to increase its solubility (see Section C3 below).

ii. Stabilin-1 and Stabilin-2

Exemplary of a Type A sub-group HABP provided for use as a companion diagnostic reagent in the methods provided herein is Stabilin-1 or Stabilin-2, or a link module thereof, a sufficient portion of a link module to bind to HA, variants thereof or multimers thereof. Stabilin-1 (also called STAB1, CLEVER-1, KIAA0246, FEEL-1, FEX-1 and FELE-1; SEQ ID NO:223) and Stabilin-2 (also called STAB2, FEEL-2, CD-44 like precursor FELL2, DKFZp434E0321, FEX2, and hyaluronan receptor for endocytosis/HARE; SEQ ID NO:224) are type I transmembrane members of a family of fasciclin-like hyaluronan (HA) receptor homologs. Both contain seven fasciclin-like adhesion domains, multiple EGF-like repeats, and hyaluronan-binding link modules. Both Stabilin-1 and Stabilin-2 are expressed on sinusoidal endothelium and macrophages, though each is functionally distinct. Stabilin-1 is involved in two intracellular trafficking pathways: receptor mediated endocytosis and recycling; and shuttling between the endosomal compartment and trans-Golgi network (TGN). Stabilin-2 acts as a scavenger receptor for HA and AGE-modified proteins.

The precursor sequence of Stabilin-1 is set forth in SEQ ID NO:223. The link module of Stabilin-1 is located at 2208-2300 of SEQ ID NO:223 and is set forth in SEQ ID NO:371. The precursor sequence of Stabilin-2 is set forth in SEQ ID NO:224 and the link module of Stabilin-2 is located at amino acids 2198-2290 of SEQ ID NO:224 and is set forth in SEQ ID NO:372.

Stabilin-1 or Stabilin-2 polypeptides, HA binding domains thereof, e.g., Stabilin-LM modules or fragments thereof sufficient to bind to HA provided herein for use as a companion diagnostic in the methods herein include the link module set forth in SEQ ID NO:371 or 372, or variants thereof that exhibit at least 65%, 70%, 75%, 80%, 85%, 90%, 91%, 92%, 93%, 94%, 95%, 96%, 97%, 98%, 99% or more sequence identity to any one of SEQ ID NOS: 371 or 372. The variants include variants that exhibit specific binding to HA. Variants include allelic variants, species variants or other variants containing an amino acid modification (e.g. to increase affinity or specificity to HA). Species variants of stabilin-1 provided for use in the methods herein include, but are not limited to, mouse (SEQ ID NO:255) and bovine (SEQ ID NO:256) and species variants of stabilin-2 provided for use in the methods herein include, but are not limited to, mouse (SEQ ID NO:257) and rat (SEQ ID NO:258).

Also provided herein for use as a companion diagnostic in the methods herein is a Stabilin-1-LM or Stabilin-1-LM multimer that exhibits increased affinity for HA. For example, a companion diagnostic for use in the methods herein is one that is generated by expression of a nucleic acid molecule encoding the link module set forth in any one of SEQ ID NOS: 371 or 372 or a nucleic acid encoding a link module having a sequence of amino acids that exhibits at least 65%, 70%, 75%, 80%, 84%, 90%, 91%, 92%, 93%, 94%, 95%, 96%, 97%, 98%, or 99% sequence identity to a sequence set forth in any of SEQ ID NOS: 371 or 372 linked directly or indirectly to a nucleic acid encoding a multimerization domain, such as an Fc portion of an immunoglobulin. Hence, the resulting LM multimer contains a first polypeptide set forth in any one of SEQ ID NOS: 371 or 372 or a sequence of amino acids that exhibits at least 65%, 70%, 75%, 80%, 84%, 90%, 91%, 92%, 93%, 94%, 95%, 96%, 97%, 98%, or 99% sequence identity to a sequence set forth in any of SEQ ID NOS: 371 or 372 linked directly or indirectly to a multimerization domain; and a second polypeptide set forth in any one of SEQ ID NOS: 371 or 372 or a sequence of amino acids that exhibits at least 65%, 70%, 75%, 80%, 84%, 90%, 91%, 92%, 93%, 94%, 95%, 96%, 97%, 98%, or 99% sequence identity to a sequence set forth in any of SEQ ID NOS: 371 or 372 linked directly or indirectly to a multimerization domain.

b. Type B: CD44 Sub-Group

Provided herein as a companion diagnostic reagent for use in the methods herein are HABPs that are members of the Type B sub-group having an HA-binding domain that contains a single link module with N- and C-terminal extensions that binds to hyaluronan. Unlike the HA binding domain of the Type A/TSG-6 sub-group, the flanking sequences of the link domain are essential for the structural integrity of the Type B domain and are required for binding to HA. Members of the Type B sub-group of HABPs for use in the methods provided herein include, but are not limited to, CD44 and LYVE-1, or HA binding fragments thereof.

i. CD44

A Type B sub-group HABP provided for use in the methods herein is CD44, HA binding domains of CD44 or portions thereof sufficient to bind to HA. CD44 is an 80- to 250-kDa Type I transmembrane glycoprotein that binds hyaluronan and a variety of extracellular and cell-surface ligands. CD44 has diverse functions and is involved in attachment, organization and turnovers of the extracellular matrix and mediates the migration of lymphocytes during inflammation. The ability of CD44 to interact with HA is regulated by factors, including receptor clustering and changes in glycosylation of the extracellular domain. CD exists in numerous isoforms due to alternative splicing of 10 variant exons, all of which contain the hyaluronan binding domain containing the link module. An exemplary CD44 full length sequence is set forth in SEQ ID NO:227. The hyaluronan binding domain of CD44 is approximately 160 amino acids in length (SEQ ID NO: 341) and contains the link module flanked by N- and C-terminal extensions linked by a disulfide bond (Cys9 and Cys110 of the CD44 HA binding domain set forth in SEQ ID NO: 341). Arg41 and Arg78 are critical for HA binding (corresponding to amino acids Arg22 and Arg59 of the CD44 HA binding domain set forth in SEQ ID NO: 341) and Tyr42 and Tyr79 (corresponding to amino acids Tyr23 and Tyr60 of the CD44 HA binding domain set forth in SEQ ID NO: 341) are essential for CD44 functional activity. The link domain of CD44 is set forth in SEQ ID NO:375. Thus provided herein for use in the methods herein are fragments of CD44 that retain the ability to bind to HA, for example, a fragment of CD44 that contains a link domain and N- and C-terminal flanking domains or a sufficient portion thereof to effect binding to HA.

Also provided herein for use in the provided methods are variants, including allelic variants, species variants and other variants containing an amino acid modification, as long as the variants retain their ability to bind to HA. Species variants of CD44 for use in the methods provided herein include, but are not limited to, mouse (SEQ ID NO:259), rat (SEQ ID NO:260), bovine (SEQ ID NO:261), dog (SEQ ID NO:262), horse (SEQ ID NO:263), hamster (SEQ ID NO:264), baboon (SEQ ID NO:265) and golden hamster (SEQ ID NO:266). Variants of CD44, or HA binding fragments thereof, for use in the provided methods include variants that have an amino acid modification and that exhibit an altered, such as improved, activity compared to a CD44 not containing the modification. Such variants include those that contain amino acid modifications that enhance the binding affinity of CD44 to HA, increase the specificity of CD44 for HA, and/or increase the solubility of CD44.

ii. LYVE-1

Provided herein for use in the methods provided herein is a Type B sub-group HABP that is LYVE-1, HA binding domains of LYVE-1 or portions thereof sufficient to bind to HA. Lymphatic Vessel Endothelial Hyaluronan (HA) Receptor-1 (LYVE-1, also called CRSBP-1, HAR, and XLKD1; SEQ ID NO:228) is a 60-kDa type I transmembrane glycoprotein that is expressed on both the lumenal and ablumenal surfaces of lymphatic endothelium, and also on hepatic blood sinusoidal endothelia. LYVE-1 participates in HA internalization for degradation and transport of HA from tissues into the lumen of lymphatic vessels. LYVE-1-directed HA localization to lymphatic surfaces also affects aspects of the immune response or tumor metastases. The link module of LYVE-1 is located at amino acids 40-129 of SEQ ID NO:228 and is set forth in SEQ ID NO:376. Thus provided herein for use in the methods herein are fragments of LYVE-1 that retain the ability to bind to HA, for example, a fragment of LYVE-1 that contains a link domain and N- and C-terminal flanking domains or a sufficient portion thereof to effect binding to HA.

Also provided herein for use in the provided methods are variants, including allelic variants, species variants and other variants containing an amino acid modification, as long as the variants retain their ability to bind to HA. Species variants of LYVE-1 include, but are not limited to, mouse (SEQ ID NO:267) and bovine (SEQ ID NO:268). Variants of LYVE-1, or HA binding fragments thereof, for use in the provided methods include variants that have an amino acid modification and that exhibit an altered, such as improved, activity compared to a LYVE-1 not containing the modification. Such variants include those that contain amino acid modifications that enhance the binding affinity of LYVE-1 to HA, increase the specificity of LYVE-1 for HA, and/or increase the solubility of LYVE-1.

c. Type C: Link Protein Sub-Group

Provided herein for use as a companion diagnostic reagent in the methods herein are HABPs that are members of the Type C sub-group having an HA binding domain that contains an immunoglobulin (Ig) domain, which mediates binding between link protein and other Type C HA binding proteins, and two link modules, both of which are required for binding to HA. The Ig domain and two link modules collectively make up the G1 domain of Type C HABPs. Members of the Type C sub-group of HABPs for use in the methods provided herein include, but are not limited to, HAPLN1/link protein, HAPLN2, HAPLN3, HAPLN4, aggrecan, versican, brevican, neurocan, and phosphacan, or HA binding fragments thereof.

i. HAPLN/Link Protein Family

The Hyaluronan and Proteoglycan Link Protein (HAPLN) family is made up of four secreted proteoglycans that bind hyaluronan and contain one Ig-type C2-set domain and two link domains.

(1) HAPLN1

A Type C sub-group HABP provided herein for use in the methods is HAPLN 1, HA binding domains of HAPLN 1 or portions thereof sufficient to bind to HA. Hyaluronan and Proteoglycan Link Protein 1 (HAPLN1, also called as link protein and CRTL1; SEQ ID NO: 229) contributes to extracellular matrix stability and flexibility by stabilizing interactions of HA with chondroitin sulfate proteoglycans. HALPN1 contains two link modules (amino acids 159-253 and amino acids 260-350 of SEQ ID NO: 229) that bind to HA and an Ig module (amino acids 53-160 of SEQ ID NO: 229) that binds to the Ig module of the G1 domain of aggrecan. HAPLN1 stabilizes associations of HA with aggrecan by forming a ternary complex containing an HA linear backbone with perpendicularly attached aggrecan and HAPLN 1. Aggrecan and HAPLN1 lie parallel to each other, while HA runs between the two HAPLN1 link modules and the two aggrecan link modules. The complex creates a gel-like substance with resistance to deformation. HAPLN1 also stabilizes the interaction of HA with other chondroitin sulfate proteoglycans, such as versican, neurocan, and brevican, which also have G1 domains containing an Ig module and two link modules, similar to aggrecan.

The G1 domain of HAPLN1 contains the Ig domain and the 2 link modules. The Ig domain of the G1 domain of HAPLN1 is located at amino acids 53-160 of SEQ ID NO:229. The link modules of the G1 domain of HAPLN1 are located at amino acids 159-253 and 259-350 of SEQ ID NO:229 and are set forth in SEQ ID NOS:377 and 378. Thus, provided herein for use in the methods herein are fragments of HAPLN1 that retain the ability to bind to HA, for example, a fragment of HAPLN1 that contains the G1 domain or a sufficient portion thereof to effect binding to HA. For example, provided herein for use in the methods herein is a HA binding fragment of HAPLN1 that contains at least the two link modules.

Typically, for use as a diagnostic for the detection of HA, HAPLN 1 is provided in combination with another HA binding protein that contains the HA-binding region, such as, for example, the G1 domain of another Type C HABP, such as aggrecan, versican, brevican, neurocan, or phosphacan.

Also provided herein for use in the provided methods are variants, including allelic variants, species variants and other variants containing an amino acid modification, as long as the variants retain their ability to bind to HA. Species variants of HAPLN1 include, but are not limited to, bovine (SEQ ID NO:269 and 273), mouse (SEQ ID NO:270), rat (SEQ ID NO:271), chicken (SEQ ID NO:272), horse (SEQ ID NO:274) and pig (SEQ ID NO:275). Variants of HAPLN1, or HA binding fragments thereof, for use in the provided methods include variants that have an amino acid modification and that exhibit an altered, such as improved, activity compared to a HAPLN1 not containing the modification. Such variants include those that contain amino acid modifications that enhance the binding affinity of HAPLN1 to HA, increase the specificity of HAPLN1 for HA, and/or increase the solubility of HAPLN1.

(2) HAPLN2

Provided herein for use in the methods provided herein is a Type C sub-group HABP that is HAPLN2, HA binding domains of HAPLN2 or portions thereof sufficient to bind to HA. Hyaluronan and Proteoglycan Link Protein 2 (HAPLN2; SEQ ID NO: 230), also known as brain link protein 1, is predominantly expressed in brain. The G1 domain of HAPLN2 contains the Ig domain and the 2 link modules. The Ig domain of the G1 domain of HAPLN2 is located at amino acids 49-149 of SEQ ID NO:230. The link modules of the G1 domain of HAPLN2 are located at amino acids 148-241 and 247-337 of SEQ ID NO:230 and are set forth in SEQ ID NOS:379 and 380.

Thus, provided herein for use in the methods herein are fragments of HAPLN2 that retain the ability to bind to HA, for example, a fragment of HAPLN2 that contains the G1 domain or a sufficient portion thereof to effect binding to HA. For example, provided herein for use in the methods herein is a HA binding fragment of HAPLN2 that contains at least the two link modules. Typically, for use as a diagnostic for the detection of HA, HAPLN2 is provided in combination with another HA binding protein that contains the HA-binding region, such as, for example, the G1 domain of another Type C HABP, such as aggrecan, versican, brevican, neurocan, or phosphacan.

Also provided herein for use in the provided methods are variants, including allelic variants, species variants and other variants containing an amino acid modification, as long as the variants retain their ability to bind to HA. Species variants of HAPLN2 include, but are not limited to, mouse (SEQ ID NO:276), rat (SEQ ID NO:277) and bovine (SEQ ID NO:278). Variants of HAPLN2, or HA binding fragments thereof, for use in the provided methods include variants that have an amino acid modification and that exhibit an altered, such as improved, activity compared to a HAPLN2 not containing the modification. Such variants include those that contain amino acid modifications that enhance the binding affinity of HAPLN2 to HA, increase the specificity of HAPLN1 for HA, and/or increase the solubility of HAPLN2.

(3) HAPLN3

A Type C sub-group HABP provided herein for use in the methods herein is HAPLN3, HA binding domains of HAPLN3 or portions thereof sufficient to bind to HA. Hyaluronan and Proteoglycan Link Protein 3, (HAPLN3; SEQ ID NO:231), functions in hyaluronic acid binding and cell adhesion. HAPLN3 is upregulated in breast cancer and, thus, may be related to cancer development and metastasis. The G1 domain of HAPLN3 contains the Ig domain and the 2 link modules. The Ig domain of the G1 domain of HAPLN3 is located at amino acids 62-167 of SEQ ID NO:231. The link modules of the G1 domain of HAPLN3 are located at amino acids 166-260 and 266-357 of SEQ ID NO:231 and are set forth in SEQ ID NOS:381 and 382.

Thus, provided herein for use in the methods herein are fragments of HAPLN3 that retain the ability to bind to HA, for example, a fragment of HAPLN3 that contains the G1 domain or a sufficient portion thereof to effect binding to HA. For example, provided herein for use in the methods herein is a HA binding fragment of HAPLN3 that contains at least the two link modules. Typically, for use as a diagnostic for the detection of HA, HAPLN3 is provided in combination with another HA binding protein that contains the HA-binding region, such as, for example, the G1 domain of another Type C HABP, such as aggrecan, versican, brevican, neurocan, or phosphacan.

Also provided herein for use in the methods herein are variants, including allelic variants, species variants and other variants containing an amino acid modification, as long as the variants retain their ability to bind to HA. Species variants of HAPLN3 include, but are not limited to, mouse (SEQ ID NO:279), rat (SEQ ID NO:280) and bovine (SEQ ID NO:281). Variants of HAPLN3, or HA binding fragments thereof, for use in the provided methods include variants that have an amino acid modification and that exhibit an altered, such as improved, activity compared to a HAPLN3 not containing the modification. Such variants include those that contain amino acid modifications that enhance the binding affinity of HAPLN3 to HA, increase the specificity of HAPLN3 for HA, and/or increase the solubility of HAPLN3.

(4) HAPLN4

Provided herein for use in the methods herein is a Type C sub-group HABP that is HAPLN4, HA binding domains of HAPLN4 or portions thereof sufficient to bind to HA. Hyaluronan and Proteoglycan Link Protein 4, (HAPLN4; SEQ ID NO:232), also known as brain link protein 2, is predominantly expressed in brain. HAPLN4 participates in the development of the perineuronal matrix. Human and mouse HAPLN4 share 91% amino acid sequence identity. The G1 domain of HAPLN4 contains the Ig domain and the 2 link modules. The Ig domain of the G1 domain of HAPLN4 is located at amino acids 60-164 of SEQ ID NO:232. The link modules of the G1 domain of HAPLN4 are located at amino acids 163-267 and 273-364 of SEQ ID NO:232 and are set forth in SEQ ID NOS:383 and 384.

Thus, provided herein for use in the methods herein are fragments of HAPLN4 that retain the ability to bind to HA, for example, a fragment of HAPLN4 that contains the G1 domain or a sufficient portion thereof to effect binding to HA. For example, provided herein for use in the methods herein is a HA binding fragment of HAPLN4 that contains at least the two link modules. Typically, for use as a diagnostic for the detection of HA, HAPLN4 is provided in combination with another HA binding protein that contains the HA-binding region, such as, for example, the G1 domain of another Type C HABP, such as aggrecan, versican, brevican, neurocan, or phosphacan.

Also provided herein for use in the provided methods are variants of HAPLN4, including allelic variants, species variants and other variants containing an amino acid modification, as long as the variants retain their ability to bind to HA. Species variants of HAPLN4 include, but are not limited to, mouse (SEQ ID NO:282), bovine (SEQ ID NO:283) and rat (SEQ ID NO:284). Variants of HAPLN4, or HA binding fragments thereof, for use in the provided methods include variants that have an amino acid modification and that exhibit an altered, such as improved, activity compared to a HAPLN4 not containing the modification. Such variants include those that contain amino acid modifications that enhance the binding affinity of HAPLN4 to HA, increase the specificity of HAPLN4 for HA, and/or increase the solubility of HAPLN4.

(5) Aggrecan

Provided herein for use in the methods herein is a Type C sub-group HABP that is aggrecan, HA binding domains of aggrecan or portions thereof sufficient to bind to HA. Aggrecan (SEQ ID NO:233) belongs to the chondroitin sulfate (CS) proteoglycan family, which also includes versican, brevican, neurocan, and phosphacan. Each aggrecan molecule contains approximately 100 and 30 keratan sulfate and glycosaminoglycan (GAG) side chains, respectively. Aggrecan non-covalently associates with hyaluronan via the link modules and an Ig domain in its N-terminus. It is the most abundant proteoglycan in cartilage, and contributes to the load-bearing capacity of this tissue.

The G1 domain of aggrecan is located at amino acids 45-352 of SEQ ID NO:233. The Ig domain of the G1 domain of aggrecan is located at amino acids 45-154 of SEQ ID NO:233 and is set forth in SEQ ID NO:423. The link modules of the G1 domain of aggrecan are located at amino acids 153-247 and 254-349 of SEQ ID NO:233 and are set forth in SEQ ID NOS:385 and 386. Link modules 3 and 4 are set forth in SEQ ID NOS:387 and 388. Thus, provided herein for use in the methods herein are fragments of aggrecan that retain the ability to bind to HA, for example, a fragment of aggrecan that contains the G1 domain or a sufficient portion thereof to effect binding to HA.

Also provided herein for use in the provided methods are variants of aggrecan, including allelic variants, species variants and other variants containing an amino acid modification, as long as the variants retain their ability to bind to HA. Species variants of aggrecan include, but are not limited to, pig (SEQ ID NO:285), chicken (SEQ ID NO:286), mouse (SEQ ID NO:287), bovine (SEQ ID NO:288), dog (SEQ ID NO:289), rat (SEQ ID NO:290) and rabbit (SEQ ID NO:291). Variants of aggrecan, or HA binding fragments thereof, for use in the provided methods include variants that have an amino acid modification and that exhibit an altered, such as improved, activity compared to an aggrecan not containing the modification. Such variants include those that contain amino acid modifications that enhance the binding affinity of aggrecan to HA, increase the specificity of aggrecan for HA, and/or increase the solubility of aggrecan.

(6) Brevican

Provided herein for use in the methods herein is a Type C sub-group HABP that is brevican, HA binding domains of brevican or portions thereof sufficient to bind to HA. Brevican (SEQ ID NO:234) is a 160 kDa member of the aggrecan/versican proteoglycan family of matrix proteins. It is brain-derived and serves as a linker between hyaluronan and other matrix molecules such as the tenascins and fibulins. The G1 domain of brevican is located at amino acids 51-356 of SEQ ID NO:234 and is set forth in SEQ ID NO:424. The Ig domain of the G1 domain of brevican is located at amino acids 51-158 of SEQ ID NO:234. The link modules of the G1 domain of brevican are located at amino acids 157-251 and 258-353 of SEQ ID NO:234 and are set forth in SEQ ID NOS:389 and 390. Thus, provided herein for use in the methods herein are fragments of brevican that retain the ability to bind to HA, for example, a fragment of brevican that contains the G1 domain or a sufficient portion thereof to effect binding to HA. For example, provided herein for use in the methods herein is a HA binding fragment of brevican that contains at least the two link modules.

Also provided herein for use in the provided methods are variants of brevican, including allelic variants, species variants and other variants containing an amino acid modification, as long as the variants retain their ability to bind to HA. Species variants of brevican include, but are not limited to, rat (SEQ ID NO:292), mouse (SEQ ID NO:293), bovine (SEQ ID NO:294) and cat (SEQ ID NO:295). Variants of brevican, or HA binding fragments thereof, for use in the provided methods include variants that have an amino acid modification and that exhibit an altered, such as improved, activity compared to a brevican not containing the modification. Such variants include those that contain amino acid modifications that enhance the binding affinity of brevican to HA, increase the specificity of brevican for HA, and/or increase the solubility of brevican.

(7) Versican

Provided herein for use in the methods herein is a Type C sub-group HABP that is versican, HA binding domains of versican or portions thereof sufficient to bind to HA. Versican (SEQ ID NO:235) is a large extracellular matrix proteoglycan that is present in a variety of tissues. It plays important structural roles, forming loose, hydrated matrices during development and disease. It also interacts directly or indirectly with cells to regulate such physiological processes as cell adhesion, survival, proliferation, and motility. The G1 domain of versican is located at amino acids 38-349 of SEQ ID NO:235 and is set forth in SEQ ID NO:425. The Ig domain of the G1 domain of versican is located at amino acids 38-151 of SEQ ID NO:235. The link modules of the G1 domain of versican are located at amino acids 150-244 and 251-346 of SEQ ID NO:235 and are set forth in SEQ ID NOS:391 and 392. Thus, provided herein for use in the methods herein are fragments of versican that retain the ability to bind to HA, for example, a fragment of versican that contains the G1 domain or a sufficient portion thereof to effect binding to HA. For example, provided herein for use in the methods herein is a HA binding fragment of versican that contains at least the two link modules.

Also provided herein for use in the provided methods are variants of versican, including allelic variants, species variants and other variants containing an amino acid modification, as long as the variants retain their ability to bind to HA. Species variants of versican include, but are not limited to, mouse (SEQ ID NO:296), rat (SEQ ID NO:297), pig-tailed macaque (SEQ ID NO:298), bovine (SEQ ID NO:299) and chicken (SEQ ID NO:300). Variants of versican, or HA binding fragments thereof, for use in the provided methods include variants that have an amino acid modification and that exhibit an altered, such as improved, activity compared to a versican not containing the modification. Such variants include those that contain amino acid modifications that enhance the binding affinity of versican to HA, increase the specificity of versican for HA, and/or increase the solubility of versican.

(8) Neurocan

Provided herein for use in the methods herein is a Type C sub-group HABP that is neurocan, HA binding domains of neurocan or portions thereof sufficient to bind to HA. Neurocan, also known as CSPG3 and 1D1 (SEQ ID NO:236), is a secreted chondroitin sulfate proteoglycan that is primarily expressed in the central nervous system. Human Neurocan is predicted to be cleaved following Met635, resulting in N-terminal (Neurocan-130) and C-terminal (Neurocan-C) fragments. Neurocan and Neurocan-C are produced by astrocytes and accumulate in the matrix surrounding axonal bundles and neuronal cell bodies. Neurocan-130 is found mainly in the glial cell cytoplasm. Neurocan inhibits neuronal adhesion and neurite outgrowth through interactions with a variety of matrix and transmembrane molecules. The G1 domain of neurocan is located at amino acids 53-359 of SEQ ID NO:236 and is set forth in SEQ ID NO:426. The Ig domain of the G1 domain of neurocan is located at amino acids 53-161 of SEQ ID NO:236. The link modules of the G1 domain of neurocan are located at amino acids 160-254 and 261-356 of SEQ ID NO:236 and are set forth in SEQ ID NOS:393 and 394. Thus, provided herein for use in the methods herein are fragments of neurocan that retain the ability to bind to HA, for example, a fragment of neurocan that contains the G1 domain or a sufficient portion thereof to effect binding to HA. For example, provided herein for use in the methods herein is a HA binding fragment of neurocan that contains at least the two link modules.

Also provided herein for use in the provided methods are variants of neurocan, including allelic variants, species variants and other variants containing an amino acid modification, as long as the variants retain their ability to bind to HA. Species variants of neurocan include, but are not limited to, mouse (SEQ ID NO:301), rat (SEQ ID NO:302) and chimpanzee (SEQ ID NO:303). Variants of neurocan, or HA binding fragments thereof, for use in the provided methods include variants that have an amino acid modification and that exhibit an altered, such as improved, activity compared to a neurocan not containing the modification. Such variants include those that contain amino acid modifications that enhance the binding affinity of neurocan to HA, increase the specificity of neurocan for HA, and/or increase the solubility of neurocan.

(9) Phosphacan

Provided herein for use in the method provided herein is a Type C sub-group HABP that is phosphacan, HA binding domains of phosphacan or portions thereof sufficient to bind to HA. Phosphacan (SEQ ID NO:340) a chondroitin sulfate proteoglycan isolated from rat brain that binds to neurons and neural cell-adhesion molecules and modulate cell interactions and other developmental processes in nervous tissue through heterophilic binding to cell-surface and extracellular matrix molecules, and by competition with ligands of the transmembrane phosphatase. Phosphacan has 76% identity to the extracellular portion of a human receptor-type protein tyrosine phosphatase (RPTP zeta/beta) and represent an mRNA splicing variant of the larger transmembrane protein.

Also provided herein for use in the methods herein are variants, including allelic variants, species variants and other variants containing an amino acid modification, as long as the variants retain their ability to bind to HA. Species variants of phosphacan include, but are not limited to rat phosphacan (SEQ ID NO:237). Variants of phosphacan, or HA binding fragments thereof, for use in the provided methods include variants that have an amino acid modification and that exhibit an altered, such as improved, activity compared to a phosphacan not containing the modification. Such variants include those that contain amino acid modifications that enhance the binding affinity of phosphacan to HA, increase the specificity of phosphacan for HA, and/or increase the solubility of phosphacan.

2. HA Binding Proteins without Link Modules

In some examples, provided herein for use in the methods herein are HA binding proteins that do not contain link modules. HA binding proteins without link modules for use in the methods provided herein include, but are not limited to, HABP1/C1QBP, layilin, RHAMM, IαI, CDC37, PHBP, SPACR, SPACRCAN, CD38, IHABP4 and PEP-1, or HA binding fragments thereof.

a. HABP1/C1QBP

Provided herein for use in the methods herein is a hyaluronan binding protein 1, HA binding domains of HABP1 or portions thereof sufficient to bind to HA. Hyaluronan binding protein 1 (HABP1; SEQ ID NO:240), also known as C1qBP/C1qR and p32, is a ubiquitous acidic glycoprotein that functions in spermatogenesis and as a receptor for proinflammatory molecules. HABP1 binds extracellular hyaluronan, vitronectin, complement component C1q, HMW kininogen, and bacterial and viral proteins. Intracellular HABP1 binds to molecules containing the C1q globular domain, multiple isoforms of PKC, mitochondrial Hrk, adrenergic and GABA-A receptors, the mRNA splicing factor ASF/SF2, and the CBF transcription factor.

Also provided herein for use in the methods herein are variants, including allelic variants, species variants and other variants containing an amino acid modification, as long as the variants retain their ability to bind to HA. Variants of HABP1, or HA binding fragments thereof, for use in the provided methods include variants that have an amino acid modification and that exhibit an altered, such as improved, activity compared to a HABP1 not containing the modification. Such variants include those that contain amino acid modifications that enhance the binding affinity of HABP1 to HA, increase the specificity of HABP1 for HA, and/or increase the solubility of HABP1.

b. Layilin

Provided herein for use in the methods herein is a layilin, HA binding domains of layilin or portions thereof sufficient to bind to HA. Layilin (SEQ ID NOS:238 and 239) is transmembrane protein with homology to C-type lectins and is named after the L-A-Y-I-L-I six amino acid motif in its transmembrane segment. Layilin binds specifically to hyaluronan and is found in the extracellular matrix of most animal tissues and in body fluids. It thus can modulate cell behavior and functions during tissue remodeling, development, homeostasis, and diseases.

Also provided herein for use in the methods herein are variants, including allelic variants, species variants and other variants containing an amino acid modification, as long as the variants retain their ability to bind to HA. Species variants of layilin include, but are not limited to, mouse (SEQ ID NO:304), Chinese hamster (SEQ ID NO:305) and rat (SEQ ID NO:306). Variants of layilin, or HA binding fragments thereof, for use in the provided methods include variants that have an amino acid modification and that exhibit an altered, such as improved, activity compared to a layilin not containing the modification. Such variants include those that contain amino acid modifications that enhance the binding affinity of layilin to HA, increase the specificity of layilin for HA, and/or increase the solubility of layilin.

c. RHAMM

Provided herein for use in the methods herein is a RHAMM, HA binding domains of RHAMM or portions thereof sufficient to bind to HA. The receptor for HA-mediated motility (RHAMM; SEQ ID NO:242) is a membrane-associated protein, ranging is size from ~59 to 80 kDa. RHAMM is expressed on most cell types and functions to mediate adhesion and cell motility in response to HA binding. Also provided herein for use in the methods herein are variants, including allelic variants, species variants and other variants containing an amino acid modification, as long as the variants retain their ability to bind to HA. Species variants of RHAMM include, but are not limited to, mouse (SEQ ID NO:307) and rat (SEQ ID NO:308). Variants of RHAMM, or HA binding fragments thereof, for use in the provided methods include variants that have an amino acid modification and that exhibit an altered, such as improved, activity compared to a RHAMM not containing the modification. Such variants include those that contain amino acid modifications that enhance the binding affinity of RHAMM to HA, increase the specificity of RHAMM for HA, and/or increase the solubility of HABP1.

d. Others

Other HABPs that bind to HA some of which contain hyaluronan binding domains that can be used in the methods provided herein include, but are not limited to, IαI (SEQ ID NOS:243-245), CDC37 (SEQ ID NO:250), PHBP (SEQ ID NO:251), SPACR (SEQ ID NO:246), SPACERCAN (SEQ ID NO:247), CD38 (SEQ ID NO:248), IHABP4 (SEQ ID NO:249) and PEP-1 (SEQ ID NO:241), or HA binding domains or portions thereof sufficient to bind to HA. Also provided herein for use in the methods herein are variants, including allelic variants, species variants and other variants containing an amino acid modification, as long as the variants retain their ability to bind to HA. Species variants include, but are not limited to, IαI from mouse (SEQ ID NOS:309-311) and bovine (SEQ ID NOS:312-314), CDC37 from Baker's yeast (SEQ ID NO:326), fruit fly (SEQ ID NO:327), rat (SEQ ID NO:328), mouse (SEQ ID NO:329), fission yeast (SEQ ID NO:330), fruit fly (SEQ ID NO:331), chicken (SEQ ID NO:332), bovine (SEQ ID NO:333), *Candida albicans* (SEQ ID NO:334). *C. elegans* (SEQ ID NO:335) and green pufferfish (SEQ ID NO:336), SPACR from chicken (SEQ ID NO:315) and mouse (SEQ ID NO:316), SPACRCAN from mouse (SEQ ID NO:317), rat (SEQ ID NO:318) and chicken (SEQ ID NO:319), CD38 from mouse (SEQ ID NO:320), rat (SEQ ID NO:321) and rabbit (SEQ ID NO:322), IHABP4 from mouse (SEQ ID NO:324) and chicken (SEQ ID NO:325), and PHBP from mouse (SEQ ID NO:337), rat (SEQ ID NO:338) and bovine (SEQ ID NO:339). Variants of HABPs, or HA binding fragments thereof, for use in the provided methods include variants that have an amino acid modification and that exhibit an altered, such as improved, activity compared to a HABP not containing the modification. Such variants include those that contain amino acid modifications that enhance the binding affinity of a HABP to HA, increase the specificity of a HABP for HA, and/or increase the solubility of a HABP, such as an IαI, CDC37, PHBP, SPACR, SPACRCAN, CD38, IHABP4 and PEP-1, or HA binding fragments thereof.

3. Modifications of HA Binding Proteins

Modified HABPs are provided herein to improve one or more properties of HABPs for use in the methods provided herein. Such properties include modifications increase protein expression in mammalian expression systems, improve biophysical properties such as stability and solubility, improve protein purification and detection and/or increase affinity to HA via dimerization of the fusion protein.

a. Multimers of HABP

HABPs provided for use in the methods herein can be linked directly or indirectly to a multimerization domain. The presence of a multimerization domain can generate multimers of HABPs or HA binding domains thereof to increase HA binding sites on a molecule. This can result in increased affinity of the HABP for HA. For example, affinity of an HABP multimer can be increased 2-fold, 3-fold, 4-fold, 5-fold, 6-fold, 7-fold, 8-fold, 9-fold, 10-fold or more compared to a HABP polypeptide not containing a multimerization domain. Affinity of a HABP multimer for HA, when represented as the dissociation constant (Kd), is generally at least less than or less than or $1\times10^{-8}$ M to $1\times10^{-10}$ M, such as at least less than or less than or $9\times10^{-9}$ M, $8\times10^{-9}$ M, $7\times10^{-9}$ M, $6\times10^{-9}$ M, $5\times10^{-9}$ M, $4\times10^{-9}$ M, $3\times10^{-9}$ M, $2\times10^{-9}$ M, $1\times10^{-9}$ M, $9\times10^{-10}$ M, $8\times10^{-10}$ M, $7\times10^{-10}$ M, $6\times10^{-10}$ M, $5\times10^{-10}$ M, $4\times10^{-10}$ M, $3\times10^{-10}$ M, $2\times10^{-10}$ M, $1\times10^{-10}$ M or lower Kd.

Provided herein are multimers that include an HA binding domain or sufficient portion thereof to bind HA of a first HABP and an HA binding domain or sufficient portion thereof to bind HA of a second HABP, where the first and second HA-binding domain are linked directly or indirectly via a linker to a multimerization domain. The first and second HA-binding domain can be from the same HABP or from a different HABP. For example, if the HA-binding domain is the same, then homodimers or homotrimers can be generated. If the HA binding domain is different, then heterodimers or heterotrimers can be generated. For example, HA binding domains, such as a link domain or module, of HABPs can be covalently-linked, non-covalently-linked or chemically linked to form multimers of two or more HA binding domains. The link modules can be linked to form dimers, trimers, or higher multimers. In some instances, multimers can be formed by dimerization of two or more HABP polypeptides that each contain an HA binding domain.

Any portion of a HABP including an HA binding domain can be used as a multimer partner. For example, any of the HABPs described above, or those set forth in any of SEQ ID NOS:206-207, 222-340, 407-414 or any portion of a HABP, including an HA binding domain, for example, a link domain or module and variants thereof, including any HA binding domains set forth in any of SEQ ID NOS: 341 and 371-394 can be used to generate chimeric HABP polypeptides, wherein all or part of the HABP polypeptide is linked to a multimerization domain. Typically, at least one, but sometimes both, of the HABP portions is all or a portion of a HABP sufficient to bind HA linked to a multimerization domain. Examples of HABPs, or portions thereof, for use as multimerization partners are described herein above and are set forth in any of SEQ ID NOS: 206-207, 222-341, 371-394, 407-414, 416-418 or 423-426. In some examples, at least one of the multimer partners is all or part of the HABP including the HA binding domain. For example, exemplary of multimeric HABP polypeptides is a multimer formed between the HA binding domain (e.g. link domain or link module), or portion thereof, of aggrecan, versican, neurocan, brevican, phosphacan, HAPLN1, HAPLN2, HAPLN3, HAPLN4, stabilin-1, stabilin-2, CAB61358, KIAA0527 or TSG-6 protein. Additionally, a chimeric HABP polypeptide for use in the formation of an HABP multimer can include hybrid HABP polypeptides linked to a multimerization domain. Exemplary of a multimer provided herein is a multimer, such as a homodimer, generated by multimerization of the link module (LM) of TSG-6 or sufficient portion thereof that binds to HA.

Multimerization between two HABP polypeptides can be spontaneous, or can occur due to forced linkage of two or more polypeptides. In one example, multimers can be linked by disulfide bonds formed between cysteine residues on different HABP polypeptides or domain or sufficient portions thereof that bind to HA. In another example, multimers can include an HABP polypeptide or domain or sufficient portion thereof to bind to HA joined via covalent or non-covalent interactions to peptide moieties fused to the each polypeptide. Such peptides can be peptide linkers (e.g. spacers) or peptides that have the property of promoting multimerization. In an additional example, multimers can be formed between two polypeptides through chemical linkage, such as for example, by using heterobifunctional linkers.

i. Peptide Linkers

Peptide linkers can be used to produce HABP polypeptide multimers, such as for example a multimer where at least one multimerization partner contains an HA binding domain (e.g., a link domain or module). In one example, peptide linkers can be fused to the C-terminal end of a first polypeptide and the N-terminal end of a second polypeptide. This structure can be repeated multiple times such that at least one, preferably 2, 3, 4, or more polypeptides are linked to one another via peptide linkers at their respective termini. For example, a multimer polypeptide can have a sequence $Z_1$-X-$Z_2$, where $Z_1$ and $Z_2$ are each a sequence of all or part of an HABP including an HA binding domain and where X is a sequence of a peptide linker. In some instances, $Z_1$ and/or $Z_2$ is all of an HABP including an HA binding domain. In other instances, $Z_1$ and/or $Z_2$ is part of an HABP including an HA binding domain. $Z_1$ and $Z_2$ are the same or they are different. In another example, the polypeptide has a sequence of $Z_1$-X-$Z_2$(—X—Z)$_n$, where "n" is any integer, i.e. generally 1 or 2.

Typically, the peptide linker is of a sufficient length to allow one or both HA binding domains to bind to a hyaluronan substrate or to permit interaction between the HA binding domains (e.g. interaction of two Ig modules of the G1 HA binding domains of Type C HABPs). Examples of peptide linkers include, but are not limited to: -Gly-Gly-, GGGGG (SEQ ID NO:342), GGGGS or (GGGGS)n (SEQ ID NO:343), SSSSG or (SSSSG)n (SEQ ID NO:344), GKSSGSGSESKS (SEQ ID NO:345), GGSTSGSGKSSEGKG (SEQ ID NO: 346), GSTSGSGKSSSEGSGSTKG (SEQ ID NO: 347), GSTSGSGKPGSGEGSTKG (SEQ ID NO: 348), EGKSSGSGSESKEF (SEQ ID NO: 349), or AlaAlaProAla or (AlaAlaProAla)n (SEQ ID NO:350), where n is 1 to 6, such as 1, 2, 3, or 4. Exemplary linkers include:

```
(1) Gly4Ser with NcoI ends
                                        (SEQ ID NO: 351)
CCATGGGCGG CGGCGGCTCT GCCATGG (2) (Gly4Ser)2 with NcoI ends
                                        (SEQ ID NO: 352)
CCATGGGCGG CGGCGGCTCT GGCGGCGGCG GCTCTGCCAT GG (3) (Ser4Gly)4 with NcoI ends
                                        (SEQ ID NO: 353)
CCATGGCCTC GTCGTCGTCG GGCTCGTCGT CGTCGGGCTC

GTCGTCGTCG GGCTCGTCGT CGTCGGGCGC CATGG (4) (Ser4Gly)2 with NcoI ends
                                        (SEQ ID NO: 354)
CCATGGCCTC GTCGTCGTCG GGCTCGTCGT CGTCGGGCGC CATGG
```

Linking moieties are described, for example, in Huston et al. (1988) *PNAS* 85:5879-5883, Whitlow et al. (1993) *Protein Engineering* 6:989-995, and Newton et al., (1996) *Biochemistry* 35:545-553. Other suitable peptide linkers include any of those described in U.S. Pat. No. 4,751,180 or 4,935,233, which are hereby incorporated by reference. A polynucleotide encoding a desired peptide linker can be inserted between, and in the same reading frame as a polynucleotide encoding all or part of an HABP including an HA binding domain, using any suitable conventional technique. In one example, a fusion polypeptide has from two to four HABP polypeptides, including one that is all or part of an HABP polypeptide including an HA binding domain, separated by peptide linkers.

ii. Heterobifunctional Linking Agents

Linkage of an HABP polypeptide to another HABP polypeptide to create a heteromultimeric fusion polypeptide can be direct or indirect. For example, linkage of two or more HABP polypeptides can be achieved by chemical linkage or facilitated by heterobifunctional linkers, such as any known in the art or provided herein.

Numerous heterobifunctional cross-linking reagents that are used to form covalent bonds between amino groups and thiol groups and to introduce thiol groups into proteins, are known to those of skill in this art (see, e.g., the PIERCE CATALOG, *ImmunoTechnology Catalog & Handbook,* 1992-1993, which describes the preparation of and use of such reagents and provides a commercial source for such reagents; see, also, e.g., Cumber et al. 1992) *Bioconjugate Chem.* 3:397-401; Thorpe et al. (1987) *Cancer Res.* 47:5924-5931; Gordon et al. (1987) *Proc. Natl. Acad Sci.* 84:308-312; Walden et al. (1986) *J. Mol. Cell Immunol.* 2:191-197; Carlsson et al. (1978) *Biochem. J.* 173: 723-737; Mahan et al. (1987) *Anal. Biochem.* 162:163-170; Wawrzynczak et al. (1992) *Br. J. Cancer* 66:361-366; Fattom et al. (1992) *Infection & Immun.* 60:584-589). These reagents can be used to form covalent bonds between the N-terminal portion of an HABP polypeptide including an HA binding domain and C-terminus portion of another HABP polypeptide including an HA binding domain or between each of those portions and a linker. These reagents include, but are not limited to: N-succinimidyl-3-(2-pyridyldithio)propionate (SPDP; disulfide linker); sulfosuccinimidyl 6-[3-(2-pyridyldithio)propionamido]hexanoate (sulfo-LC-SPDP); succinimidyloxycarbonyl-α-methyl benzyl thiosulfate (SMBT, hindered disulfate linker); succinimidyl 6-[3-(2-pyridyldithio) propionamido] hexanoate (LC-SPDP); sulfosuccinimidyl 4-(N-maleimidomethyl)cyclohexane-1-carboxylate (sulfo-SMCC); succinimidyl 3-(2-pyridyldithio)butyrate (SPDB; hindered disulfide bond linker); sulfosuccinimidyl 2-(7-azido-4-methylcoumarin-3-acetamide) ethyl-1,3'-dithiopropionate (SAED); sulfo-succinimidyl 7-azido-4-methylcoumarin-3-acetate (SAMCA); sulfosuccinimidyl-6-[alpha-methyl-alpha-(2-pyridyldithio)toluamido]-hexanoate (sulfo-LC-SMPT); 1,4-di-[3'-(2'-pyridyldithio)propionamido]butane (DPDPB); 4-succinimidyloxycarbonyl-α-methyl-α-(2-pyridylthio)toluene (SMPT, hindered disulfate linker); sulfosuccinimidyl-6-[α-methyl-α-(2-pyrimiyldi-thio)toluamido] hexanoate (sulfo-LC-SMPT); m-maleimidobenzoyl-N-hydroxy-succinimide ester (MBS); m-maleimidobenzoyl-N-hydroxysulfo-succinimide ester (sulfo-MBS); N-succinimidyl(4-iodoacetyl)aminobenzoate (SIAB; thioether linker); sulfosuccinimidyl-(4-iodoacetyl)amino benzoate (sulfo-SIAB); succinimidyl-4-(p-maleimi-dophenyl)butyrate (SMPB); sulfosuccinimidyl-4-(p-maleimido-phenyl) butyrate (sulfo-SMPB); azidobenzoyl hydrazide (ABH). These linkers, for example, can be used in combination with peptide linkers, such as those that increase flexibility or solubility or that provide for or eliminate steric hindrance. Any other linkers known to those of skill in the art for linking a polypeptide molecule to another molecule can be employed. General properties are such that the resulting molecule binds to HA. For in vivo diagnostic use of the HABP reagent, generally the linker must be biocompatible for administration to animals, including humans.

iii. Polypeptide Multimerization Domains

Interaction of two or more HABP polypeptides can be facilitated by their linkage, either directly or indirectly, to any moiety or other polypeptide that are themselves able to interact to form a stable structure. For example, separate encoded HABP polypeptide chains can be joined by multimerization, whereby multimerization of the polypeptides is mediated by a multimerization domain. Typically, the multimerization domain provides for the formation of a stable protein-protein interaction between a first HABP polypeptide and a second HABP polypeptide. HABP polypeptides include, for example, linkage (directly or indirectly) of a nucleic acid encoding a HA binding domain (e.g. a link domain or module) of an HABP with a nucleic acid encoding a multimerization domain. Typically, at least one multimerization partner is a nucleic acid encoding all of part of an HABP including a HA binding domain linked directly or indirectly to a multimerization domain, thus forming a chimeric molecule. Homo- or heteromultimeric polypeptides can be generated from co-expression of separate HABP polypeptides. The first and second HABP polypeptides can be the same or different.

Generally, a multimerization domain includes any capable of forming a stable protein-protein interaction. The multimerization domains can interact via an immunoglobulin sequence (e.g. Fc domain; see e.g., International Patent Pub. Nos. WO 93/10151 and WO 2005/063816 US; U.S. Pub. No. 2006/0024298; U.S. Pat. No. 5,457,035), leucine zipper (e.g. from nuclear transforming proteins fos and jun or the proto-oncogene c-myc or from General Control of Nitrogen (GCN4)), a hydrophobic region, a hydrophilic region, or a free thiol which forms an intermolecular disulfide bond between the chimeric molecules of a homo- or heteromultimer. In addition, a multimerization domain can include an amino acid sequence comprising a protuberance complementary to an amino acid sequence comprising a hole, such as is described, for example, in U.S. Pat. No. 5,731,168; International Patent Pub. Nos. WO 98/50431 and WO 2005/063816; Ridgway et al. (1996) *Protein Engineering*, 9:617-621. Such a multimerization region can be engineered such that steric interactions not only promote stable interaction, but further promote the formation of heterodimers over homodimers from a mixture of chimeric monomers. Generally, protuberances are constructed by replacing small amino acid side chains from the interface of the first polypeptide with larger side chains (e.g., tyrosine or tryptophan). Compensatory cavities of identical or similar size to the protuberances are optionally created on the interface of the second polypeptide by replacing large amino acid side chains with smaller ones (e.g., alanine or threonine). Exemplary multimerization domains are described below.

An HABP polypeptide, such as for example any provided herein, including any HA binding domain (e.g., a link domain or module) of an HABP, can be joined anywhere, but typically via its N- or C-terminus, to the N- or C-terminus of a multimerization domain to form a chimeric polypeptide The linkage can be direct or indirect via a linker. Also, the chimeric polypeptide can be a fusion protein or can be formed by chemical linkage, such as through covalent or non-covalent interactions. For example, when preparing a chimeric polypeptide containing a multimerization domain, nucleic acid encoding all or part of an HABP including an HA binding domain can be operably linked to nucleic acid encoding the multimerization domain sequence, directly or indirectly or optionally via a linker domain. Typically, the construct encodes a chimeric protein where the C-terminus of the HABP polypeptide is joined to the N-terminus of the multimerization domain. In some instances, a construct can encode a chimeric protein where the N-terminus of the HABP polypeptide is joined to the N- or C-terminus of the multimerization domain.

A polypeptide multimer contains two chimeric proteins created by linking, directly or indirectly, two of the same or different HABP polypeptides directly or indirectly to a multimerization domain. In some examples, where the multimerization domain is a polypeptide, a gene fusion encoding the HABP-multimerization domain chimeric polypeptide is inserted into an appropriate expression vector. The resulting HABP-multimerization domain chimeric proteins can be expressed in host cells transformed with the recombinant expression vector, and allowed to assemble into multimers, where the multimerization domains interact to form multivalent polypeptides. Chemical linkage of multimerization domains to HABP polypeptides can be effected using heterobifunctional linkers as discussed above.

The resulting chimeric polypeptides, and multimers formed therefrom, can be purified by any suitable method such as, for example, by affinity chromatography over Protein A or Protein G columns. Where two nucleic acid molecules encoding different HABP chimeric polypeptides are transformed into cells, formation of homo- and heterodimers will occur. Conditions for expression can be adjusted so that heterodimer formation is favored over homodimer formation.

(1) Immunoglobulin Domain

Multimerization domains include those comprising a free thiol moiety capable of reacting to form an intermolecular disulfide bond with a multimerization domain of an additional amino acid sequence. For example, a multimerization domain can include a portion of an immunoglobulin molecule, such as from IgG1, IgG2, IgG3, IgG4, IgA, IgD, IgM, or IgE. Generally, such a portion is an immunoglobulin constant region (Fc). Preparations of fusion proteins containing polypeptides fused to various portions of antibody-derived polypeptides (including the Fc domain) has been described, see e.g., Ashkenazi et al. (1991) *PNAS* 88: 10535; Byrn et al. (1990) *Nature,* 344:667; and Hollenbaugh and Aruffo, (2002) "Construction of Immunoglobulin Fusion Proteins," in *Current Protocols in Immunology*, Ch. 10, pp. 10.19.1-10.19.11.

Antibodies bind to specific antigens and contain two identical heavy chains and two identical light chains covalently linked by disulfide bonds. Both the heavy and light chains contain variable regions, which bind the antigen, and constant (C) regions. In each chain, one domain (V) has a variable amino acid sequence depending on the antibody specificity of the molecule. The other domain (C) has a rather constant sequence common among molecules of the same class. The domains are numbered in sequence from the amino-terminal end. For example, the IgG light chain is composed of two immunoglobulin domains linked from N- to C-terminus in the order $V_L$-$C_L$, referring to the light chain variable domain and the light chain constant domain, respectively. The IgG heavy chain is composed of four immunoglobulin domains linked from the N- to C-terminus in the order $V_H$-$C_H1$-$C_H2$-$C_H3$, referring to the variable heavy domain, contain heavy domain 1, constant heavy domain 2, and constant heavy domain 3. The resulting antibody molecule is a four chain molecule where each heavy chain is linked to a light chain by a disulfide bond, and the two heavy chains are linked to each other by disulfide bonds. Linkage of the heavy chains is mediated by a flexible region of the heavy chain, known as the hinge region. Fragments of antibody molecules can be generated, such as for example, by enzymatic cleavage. For example, upon protease cleavage by papain, a dimer of the heavy chain constant regions, the Fc domain, is cleaved from the two Fab regions (i.e. the portions containing the variable regions).

In humans, there are five antibody isotypes classified based on their heavy chains denoted as delta ($\delta$), gamma ($\gamma$), mu ($\mu$), and alpha ($\alpha$) and epsilon ($\epsilon$), giving rise to the IgD, IgG, IgM, IgA, and IgE classes of antibodies, respectively. The IgA and IgG classes contain the subclasses IgA1, IgA2, IgG1, IgG2, IgG3, and IgG4. Sequence differences between immunoglobulin heavy chains cause the various isotypes to differ in, for example, the number of C domains, the presence of a hinge region, and the number and location of interchain disulfide bonds. For example, IgM and IgE heavy chains contain an extra C domain (C4), that replaces the hinge region. The Fc regions of IgG, IgD, and IgA pair with each other through their C$\gamma$3, C$\delta$3, and C$\alpha$3 domains, whereas the Fc regions of IgM and IgE dimerize through their C$\mu$4 and C$\epsilon$4 domains. IgM and IgA form multimeric structures with ten and four antigen-binding sites, respectively.

HABP immunoglobulin chimeric polypeptides provided herein include a full-length immunoglobulin polypeptide. Alternatively, the immunoglobulin polypeptide is less than full length, i.e. containing a heavy chain, light chain, Fab, Fab$_2$, Fv, or Fc. In one example, the HABP immunoglobulin chimeric polypeptides are assembled as monomers or hetero- or homo-multimers, and particularly as dimers or tetramers. Chains or basic units of varying structures can be utilized to assemble the monomers and hetero- and homo-multimers. For example, an HABP polypeptide can be fused to all or part of an immunoglobulin molecule, including all or part of $C_H$, $C_L$, $V_H$, or $V_L$ domain of an immunoglobulin molecule (see. e.g., U.S. Pat. No. 5,116,964). Chimeric HABP polypeptides can be readily produced and secreted by mammalian cells transformed with the appropriate nucleic acid molecule. The secreted forms include those where the HABP polypeptide is present in heavy chain dimers; light chain monomers or dimers; and heavy and light chain heterotetramers where the HABP polypeptide is fused to one or more light or heavy chains, including heterotetramers where up to and including all four variable region analogues are substituted. In some examples, one or more than one nucleic acid fusion molecule can be transformed into host cells to produce a multimer where the HABP portions of the multimer are the same or different. In some examples, a non-HABP polypeptide light-heavy chain variable-like domain is present, thereby producing a heterobifunctional antibody. In some examples, a chimeric polypeptide can be made fused to part of an immunoglobulin molecule lacking hinge disulfides, in which non-covalent or covalent interactions of the two HABP polypeptide portions associate the molecule into a homo- or heterodimer.

(a) Fc Domain

Typically, the immunoglobulin portion of an HABP chimeric protein includes the heavy chain of an immunoglobulin polypeptide, most usually the constant domains of the heavy chain. Exemplary sequences of heavy chain constant regions for human IgG sub-types are set forth in SEQ ID NOS: 355 (IgG1), SEQ ID NO: 356 (IgG2), SEQ ID NO: 357 (IgG3), and SEQ ID NO: 358 (IgG4). For example, for the exemplary heavy chain constant region set forth in SEQ ID NO: 355, the $C_H1$ domain corresponds to amino acids 1-98, the hinge region corresponds to amino acids 99-110, the $C_H2$ domain corresponds to amino acids 111-223, and the $C_H3$ domain corresponds to amino acids 224-330.

In one example, an immunoglobulin polypeptide chimeric protein can include the Fc region of an immunoglobulin polypeptide. Typically, such a fusion retains at least a functionally active hinge, $C_H2$ and $C_H3$ domains of the constant region of an immunoglobulin heavy chain. For example, a full-length Fc sequence of IgG1 includes amino acids 99-330 of the sequence set forth in SEQ ID NO:355. An exemplary Fc sequence for hIgG1 is set forth in SEQ ID NO: 359, and contains almost all of the hinge sequence, and the complete sequence for the $C_H2$ and $C_H3$ domain. Another exemplary Fc polypeptide is the Fc polypeptide set forth in SEQ ID NO: 204. Another exemplary Fc polypeptide is set forth in PCT application WO 93/10151, and is a single chain polypeptide extending from the N-terminal hinge region to the native C-terminus of the Fc region of a human IgG1 antibody (SEQ ID NO:359). The precise site at which the linkage is made is not critical: particular sites are well known and can be selected in order to optimize the biological activity, secretion, or binding characteristics of the HABP polypeptide. For example, other exemplary Fc polypeptide sequences begin at amino acid C109 or P113 of the sequence set forth in SEQ ID NO: 355 (see e.g., U.S. Pub. No. 2006/0024298).

In addition to hIgG1 Fc, other Fc regions also can be included in the HABP chimeric polypeptides provided herein. For example, where effector functions mediated by Fc/Fc$\gamma$R interactions are to be minimized, fusion with IgG isotypes that poorly recruit complement or effector cells, such as for example, the Fc of IgG2 or IgG4, is contemplated. Additionally, the Fc fusions can contain immunoglobulin sequences that are substantially encoded by immunoglobulin genes belonging to any of the antibody classes, including, but not limited to IgG (including human subclasses IgG1, IgG2, IgG3, or IgG4), IgA (including human subclasses IgA1 and IgA2), IgD, IgE, and IgM classes of antibodies. Further, linkers can be used to covalently link Fc to another polypeptide to generate a Fc chimera.

Modified Fc domains also are contemplated herein for use in chimeras with HABP polypeptides. In some examples, the Fc region is modified such that it exhibits altered binding to an FcR so has to result altered (i.e. more or less) effector function than the effector function of an Fc region of a wild-type immunoglobulin heavy chain. Thus, a modified Fc domain can have altered affinity, including but not limited to, increased or low or no affinity for the Fc receptor. For example, the different IgG subclasses have different affinities for the FcγRs, with IgG1 and IgG3 typically binding substantially better to the receptors than IgG2 and IgG4. In addition, different FcγRs mediate different effector functions. FcγR1, FcγRIIa/c, and FcγRIIIa are positive regulators of immune complex triggered activation, characterized by having an intracellular domain that has an immunoreceptor tyrosine-based activation motif (ITAM). FcγRIIb, however, has an immunoreceptor tyrosine-based inhibition motif (ITIM) and is therefore inhibitory. In some instances, an HABP polypeptide Fc chimeric protein provided herein can be modified to enhance binding to the complement protein C1q. Further, an Fc can be modified to alter its binding to FcRn, thereby improving the pharmacokinetics of an HABP-Fc chimeric polypeptide. Thus, altering the affinity of an Fc region for a receptor can modulate the effector functions and/or pharmacokinetic properties associated by the Fc domain. Modified Fc domains are known to one of skill in the art and described in the literature, see e.g. U.S. Pat. No. 5,457,035; U.S. Patent Publication No. US 2006/0024298; and International Patent Publication No. WO 2005/063816 for exemplary modifications.

Typically, a polypeptide multimer is a dimer of two chimeric proteins created by linking, directly or indirectly, two of the same or different HABP polypeptides to an Fc polypeptide. In some examples, a gene fusion encoding the HABP-Fc chimeric protein is inserted into an appropriate expression vector. The resulting HABP-Fc chimeric proteins can be expressed in host cells transformed with the recombinant expression vector, and allowed to assemble much like antibody molecules, where interchain disulfide bonds form between the Fc moieties to yield divalent HABP polypeptides.

The resulting chimeric polypeptides containing Fc moieties, and multimers formed therefrom, can be easily purified by affinity chromatography over Protein A or Protein G columns. For the generation of heterodimers, additional steps for purification can be necessary. For example, where two nucleic acids encoding different HABP chimeric polypeptides are transformed into cells, the formation of heterodimers must be biochemically achieved since HABP chimeric molecules carrying the Fc-domain will be expressed as disulfide-linked homodimers as well. Thus, homodimers can be reduced under conditions that favor the disruption of interchain disulfides, but do no effect intra-chain disulfides. Typically, chimeric monomers with different HA-binding domain portions are mixed in equimolar amounts and oxidized to form a mixture of homo- and heterodimers. The components of this mixture are separated by chromatographic techniques. Alternatively, the formation of this type of heterodimer can be biased by genetically engineering and expressing HABP fusion molecules that contain an HABP polypeptide, followed by the Fc-domain of hIgG, followed by either c-jun or the c-fos leucine zippers (see below). Since the leucine zippers form predominantly heterodimers, they can be used to drive the formation of the heterodimers when desired.

HABP chimeric polypeptides containing Fc regions also can be engineered to include a tag with metal chelates or other epitope. The tagged domain can be used for rapid purification by metal-chelate chromatography, and/or by antibodies, to allow for detection of western blots, immunoprecipitation, or activity depletion/blocking in bioassays.

Exemplary HABP-Fc chimeric polypeptides include fusion protein of the TSG-6 link module (TSG-6-LM) and Fc. An exemplary TSG-6-LM-Fc is set forth in SEQ ID NO: 212, and encoded by a sequence of nucleotides set forth in SEQ ID NO: 211. In addition, HABP-Fc molecules, including for example the exemplary TSG-6-Fc molecules, can optionally contain an epitope tag or a signal for expression and secretion. For example, the exemplary TSG-6-LM-Fc chimeric polypeptide set forth as SEQ ID NO:212 contains human immunoglobulin light chain kappa (κ) leader signal peptide sequence (SEQ ID NO: 210), an Fc fragment of the human IgG1 heavy chain (SEQ ID NO:204) and a human TSG-6 link module (SEQ ID NO:207). The cDNA sequence encoding the TSG-6-LM-Fc chimeric polypeptide is set forth in SEQ ID NO: 211. The DNA encoding human IgG1 heavy chain and human TSG-6 link module regions are connected with a 6 bp AgeI restriction enzyme cleavage site and a 12 bp sequence, GACAAAACTCAC (SEQ ID NO: 208), encoding four additional amino acids (DKTH; SEQ ID NO: 209)

(2) Leucine Zipper

Another method of preparing HABP polypeptide multimers for use in the methods provided herein involves use of a leucine zipper domain. Leucine zippers are peptides that promote multimerization of the proteins in which they are found. Typically, leucine zipper is a term used to refer to a repetitive heptad motif containing four to five leucine residues present as a conserved domain in several proteins. Leucine zippers fold as short, parallel coiled coils, and are believed to be responsible for oligomerization of the proteins of which they form a domain. The dimer formed by a leucine zipper domain is stabilized by the heptad repeat, designated (abcdefg)n (see e.g., McLachlan and Stewart (1978) *J. Mol. Biol.* 98:293), in which residues a and d are generally hydrophobic residues, with d being a leucine, which lines up on the same face of a helix. Oppositely-charged residues commonly occur at positions g and e. Thus, in a parallel coiled coil formed from two helical leucine zipper domains, the “knobs” formed by the hydrophobic side chains of the first helix are packed into the “holes” formed between the side chains of the second helix.

Exemplary leucine zippers for use as multimerization domains herein are derived from either of two nuclear transforming proteins, fos and jun, that exhibit leucine zipper domains, or the product of the murine proto-oncogene, c-myc. The leucine zipper domain is necessary for biological activity (DNA binding) in these proteins. The products of the nuclear oncogenes fos and jun contain leucine zipper domains that preferentially form a heterodimer (O’Shea et al. (1989) *Science,* 245:646; Turner and Tijian (1989) *Science,* 243:1689). For example, the leucine zipper domains of the human transcription factors c-jun and c-fos have been shown to form stable heterodimers with a 1:1 stoichiometry (see e.g., Busch and Sassone-Corsi (1990) *Trends Genetics,* 6:36-40; Gentz et al., (1989) *Science,* 243:1695-1699). Although jun-jun homodimers also have been shown to form, they are about 1000-fold less stable than jun-fos heterodimers.

Thus, typically an HABP polypeptide multimer provided herein is generated using a jun-fos combination. Generally, the leucine zipper domain of either c-jun or c-fos is fused in frame at the C-terminus of an HABP of a polypeptide by genetically engineering fusion genes. Exemplary amino acid sequences of c-jun and c-fos leucine zippers are set forth in SEQ ID NOS:362 and 363, respectively. In some instances, a sequence of a leucine zipper can be modified, such as by the addition of a cysteine residue to allow formation of disulfide bonds, or the addition of a tyrosine residue at the C-terminus to facilitate measurement of peptide concentration. Such exemplary sequences of encoded amino acids of a modified c-jun and c-fos leucine zipper are set forth in SEQ ID NOS: 362 and 363, respectively. In addition, the linkage of an HABP polypeptide with a leucine zipper can be direct or can employ a flexible linker domain, such as for example a hinge region of IgG, or other polypeptide linkers of small amino acids such as glycine, serine, threonine, or alanine at various lengths and combinations. In some instances, separation of a leucine zipper from the C-terminus of an encoded polypeptide can be effected by fusion with a sequence encoding a protease cleavage site, such as for example, a thrombin cleavage site. Additionally, the chimeric proteins can be tagged, such as for example, by a 6×His tag, to allow rapid purification by metal chelate chromatography and/or by epitopes to which antibodies are available, such as for example a myc tag, to allow for detection on western blots, immunoprecipitation, or activity depletion/blocking bioassays.

Another exemplary leucine zipper domain for use as a multimerization domain is derived from a nuclear protein that functions as a transcriptional activator of a family of genes involved in the General Control of Nitrogen (GCN4) metabolism in *S. cerevisiae*. The protein is able to dimerize and bind promoter sequences containing the recognition sequence for GCN4, thereby activating transcription in times of nitrogen deprivation. An exemplary sequence of a GCN4 leucine zipper capable of forming a dimeric complex is set forth in SEQ ID NO: 364. Amino acid substitutions in the a and d residues of a synthetic peptide representing the GCN4 leucine zipper domain (i.e. amino acid substitutions in the sequence set forth as SEQ ID NO:364) have been found to change the oligomerization properties of the leucine zipper domain. For example, when all residues at position a are changed to isoleucine, the leucine zipper still forms a parallel dimer. When, in addition to this change, all leucine residues at position d also are changed to isoleucine, the resultant peptide spontaneously forms a trimeric parallel coiled coil in solution. An exemplary sequence of such a GNC4 leucine zipper domain capable of forming a trimer is set forth in SEQ ID NO:365. Substituting all amino acids at position d with isoleucine and at position a with leucine results in a peptide that tetramerizes. Such an exemplary sequence of a leucine zipper domain of GCN4 capable of forming tetramers is set forth in SEQ ID NO:366. Peptides containing these substitutions are still referred to as leucine zipper domains since the mechanism of oligomer formation is believed to be the same as that for traditional leucine zipper domains such as the GCN4 described above and set forth in SEQ ID NO:364.

(3) Protein-Protein Interaction Between Subunits

Exemplary of another type of multimerization domain for use in modifying a HABP provided for use in the methods herein is one where multimerization is facilitated by protein-protein interactions between different subunit polypeptides. Exemplary of such a multimerization domain is derived from the mechanism of cAMP-dependent protein kinase (PKA) with its anchoring domain (AD) of A kinase anchor proteins (AKAP). Thus, a heteromultimeric HABP polypeptide can be generated by linking (directly or indirectly) a nucleic acid encoding an HABP polypeptide, such as a HA-binding domain of an HABP polypeptide, with a nucleic acid encoding an R subunit sequence of PKA (i.e. SEQ ID NO:367). This results in a homodimeric molecule, due to the spontaneous formation of a dimer effected by the R subunit. In tandem, another HABP polypeptide fusion can be generated by linking a nucleic acid encoding another HABP polypeptide to a nucleic acid sequence encoding an AD sequence of AKAP (i.e. SEQ ID NO:368). Upon co-expression of the two components, such as following co-transfection of the HABP chimeric components in host cells, the dimeric R subunit provides a docking site for binding to the AD sequence, resulting in a heteromultimeric molecule. This binding event can be further stabilized by covalent linkages, such as for example, disulfide bonds. In some examples, a flexible linker residue can be fused between the nucleic acid encoding the HABP polypeptide and the multimerization domain. In another example, fusion of a nucleic acid encoding an HABP polypeptide can be to a nucleic acid encoding an R subunit containing a cysteine residue incorporated adjacent to the amino-terminal end of the R subunit to facilitate covalent linkage (see e.g., SEQ ID NO:369). Similarly, fusion of a nucleic acid encoding a partner HABP polypeptide can be to a nucleic acid encoding an AD subunit also containing incorporation of cysteine residues to both the amino- and carboxyl-terminal ends of AD (see e.g., SEQ ID NO:370).

iv. Other Multimerization Domains

Other multimerization domains that can be used to multimerize a HABP provided for use in the methods herein are known to those of skill in the art and are any that facilitate the protein-protein interaction of two or more polypeptides that are separately generated and expressed as HABP fusions. Examples of other multimerization domains that can be used to provide protein-protein interactions between two chimeric polypeptides include, but are not limited to, the barnase-barstar module (see e.g., Deyev et al., (2003) *Nat. Biotechnol.* 21:1486-1492); use of particular protein domains (see e.g., Terskikh et al., (1997) *Proc Natl Acad Sci USA* 94: 1663-1668 and Muller et al., (1998) *FEBS Lett.* 422:259-264); use of particular peptide motifs (see e.g., de Kruif et al., (1996) *J. Biol. Chem.* 271:7630-7634 and Muller et al., (1998) *FEBS Lett.* 432: 45-49); and the use of disulfide bridges for enhanced stability (de Kruif et al., (1996) *J. Biol. Chem.* 271:7630-7634 and Schmiedl et al., (2000) *Protein Eng.* 13:725-734).

b. Mutations to Improve HA Binding

In a further example, provided herein for use in the methods herein are HABPs that are modified, such as by amino acid replacement, to exhibit increased specificity for hyaluronan compared to other GAGs. For example, provided herein is a mutant TSG-6-LM containing amino acid replacement(s) at amino acid residue 20, 34, 41, 54, 56, 72 and/or 84, and in particular at amino acid residue 20, 34, 41, and/or 54 (corresponding to amino acid residues set forth in SEQ ID NO:360). The replacement amino acid can be to any other amino acid residue, and generally is to a non-basic amino acid residue. For example, amino acid replacement can be to Asp (D), Glu (E), Ser (S), Thr (T), Asn (N), Gln (Q), Ala (A), Val (V), Ile (I), Leu (L), Met (M), Phe (F), Tyr (Y) or Trp (W). The amino acid replacement or replacements confer decreased binding to heparin. Binding can be reduced at least 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold or more compared to binding of TSG-6-LM to heparin not containing the amino acid replacement. Exemplary of a TSG-6-LM mutant for use as a reagent in the method provided herein is K20A/K34A/K41A. Hence, for example, binding to heparin is reduced such that specificity to hyaluronan is increased. The mutant TSG-6-LM can be conjugated directly or indirectly to a multimerization domain to generate multimers. For example, exemplary of a reagent for use in the methods herein is TSG-6-LM(K20A/K34A/K41A)-Fc.

c. Modifications of HA Binding Proteins for Detection

For use in the diagnostic methods provided herein, the HA binding proteins can be modified to contain a detectable protein or a moiety to facilitate detection.

i. Conjugation to Detectable Proteins or Moieties

The HA binding proteins for use in the diagnostic methods provided herein can be modified by conjugation to detectable moieties, including, but not limited to, peptides tags, radiolabels, fluorescent molecules, chemiluminescent molecules, bioluminescent molecules, Fc domains, biotin, enzymes that catalyze a detectable reaction or catalyze formation of a detectable product and proteins that bind a detectable compound. Detectable moieties, including proteins and compounds, or moieties that facilitate detection are known to one of skill in the art. The detectable moieties can be used to facilitate detection and/or purification of the HABP.

In one example, the HA binding protein is modified by conjugation to a detectable protein or to a protein that induces a detectable signal. The detectable protein or protein that induces a detectable signal can be selected from among a luciferase, a fluorescent protein, a bioluminescent protein, a receptor or transporter protein that binds to and/or transports a contrast agent, chromophore, compound or ligand that can be detected. For example, the detectable protein or protein that induces a detectable signal is a green fluorescent protein (GFP) or a red fluorescent protein (RFP).

Detectable labels can be used in any of the diagnostic methods provided herein. Exemplary detectable labels include, for example, chemiluminescent moieties, bioluminescent moieties, fluorescent moieties, radionuclides, and metals. Methods for detecting labels are well known in the art. Such a label can be detected, for example, by visual inspection, by fluorescence spectroscopy, by reflectance measurement, by flow cytometry, by X-rays, by a variety of magnetic resonance methods such as magnetic resonance imaging (MRI) and magnetic resonance spectroscopy (MRS). Methods of detection also include any of a variety of tomographic methods including computed tomography (CT), computed axial tomography (CAT), electron beam computed tomography (EBCT), high resolution computed tomography (HRCT), hypocycloidal tomography, positron emission tomography (PET), single-photon emission computed tomography (SPECT), spiral computed tomography, and ultrasonic tomography.

Exemplary of such proteins are enzymes that can catalyze a detectable reaction or catalyze formation of a detectable product, such as, for example, luciferases, such as a click beetle luciferase, a *Renilla* luciferase, a firefly luciferase or beta-glucuronidase (GusA). Also exemplary of such proteins are proteins that emit a detectable signal, including fluorescent proteins, such as a green fluorescent protein (GFP) or a red fluorescent protein (RFP). A variety of DNA sequences encoding proteins that can emit a detectable signal or that can catalyze a detectable reaction, such as luminescent or fluorescent proteins, are known and can be used in the methods provided herein. Exemplary genes encoding light-emitting proteins include, for example, genes from bacterial luciferase from *Vibrio harveyi* (Belas et al., (1982) *Science* 218:791-793), bacterial luciferase from *Vibrio fischerii* (Foran and Brown, (1988) *Nucleic acids Res.* 16:777), firefly luciferase (de Wet et al., (1987) *Mol. Cell. Biol.* 7:725-737), aequorin from *Aequorea victoria* (Prasher et al., (1987) *Biochem.* 26:1326-1332), *Renilla* luciferase from *Renilla renformis* (Lorenz et al, (1991) *Proc Natl Acad Sci USA* 88:4438-4442) and green fluorescent protein from *Aequorea victoria* (Prasher et al., (1987) *Gene* 111:229-233). The luxA and luxB genes of bacterial luciferase can be fused to produce the fusion gene (Fab$_2$), which can be expressed to produce a fully functional luciferase protein (Escher et al., (1989) *PNAS* 86: 6528-6532).

Exemplary detectable proteins that can be conjugated to the HA binding proteins for use in the diagnostic methods provided herein also include proteins that can bind a contrasting agent, chromophore, or a compound or ligand that can be detected, such as a transferrin receptor or a ferritin; and reporter proteins, such as *E. coli* β-galactosidase, β-glucuronidase, xanthine-guanine phosphoribosyltransferase (gpt), and alkaline phosphatase. Also exemplary of detectable proteins are proteins that can specifically bind a detectable compound, including, but not limited to receptors, metal binding proteins (e.g., siderophores, ferritins, transferrin receptors), ligand binding proteins, and antibodies.

The HABP also can be conjugated to a protein or peptide tag. In one example, the HA binding protein is conjugated to an Fc domain. Protein and peptide tags also include, but are not limited to, HexaHis tag (SEQ ID NO:54), hemagglutinin tag (SEQ ID NO:420), FLAG tag (SEQ ID NO:55), c-myc tag (SEQ ID NO:419), VSV-G tag (SEQ ID NO:421), HSV tag (SEQ ID NO:422) and V5 tag (SEQ ID NO:415), chitin binding protein (CBP), maltose binding protein (MBP), and glutathione s-transferase (GST).

Detectable labels can be coupled or conjugated to an HABP through recombinant methods or by chemical methods. For example, conjugation can be effected by linked the protein, directly or indirectly to a linker such as a peptide linker or a chemical linker. Linkers can be polypeptide sequences, such as poly-Glycine sequences of between about 5 and 200 amino acids. Proline residues can be incorporated into a polypeptide linker to prevent the formation of significant secondary structural elements, i.e., α-helix/β-sheet, by the linker. An example of a flexible linker is a polypeptide that includes a glycine chain with an intermediate proline. In other examples, a chemical linker is used to connect synthetically or recombinantly produced binding and labeling domain subsequences. Such flexible linkers are known to persons of skill in the art. For example, poly(ethylene glycol) linkers are available from Shearwater Polymers, Inc. Huntsville, Ala. These linkers optionally have amide linkages, sulfhydryl linkages, or heterofunctional linkages.

4. Selection of HA Binding Proteins for Diagnostic Use

An HA binding protein suitable for use as a diagnostic agent can be selected based on one or more desired properties or activities, including, but not limited to, specificity or affinity for HA, solubility, peptide stability, homogeneity, ease of expression and purification, minimum batch to batch variations in the expressed peptide, and low sample variability in HA binding and detection. In some examples, a single polypeptide diagnostic agent is contemplated over a diagnostic with multiple polypeptide components. For example, a link module that binds to HA in the absence of a complete link protein. The ability of an HABP provided herein to bind to hyaluronan can be assessed by methods well known in the art including, but not limited to ELISA-based assays, competitive binding assays with HA, heparin and other glycosaminoglycans, such as chondroitin sulfates A or C, heparan sulfates or dermatan sulfates. Exemplary assays for assessing HA binding activity are provided herein in Section D and in the Examples.

D. ASSAYS AND CLASSIFICATION

The methods provided herein are based on assaying the expression or levels of hyaluronan (HA) in a sample or samples, such as a tissue sample or body fluid sample. The methods herein are based on binding methods using a hyaluronan binding protein companion diagnostic (HABP, such as a TSG-6-LM, multimer or variant thereof) for assessing, evaluating, determining, quantifying and/or otherwise specifically detecting hyaluronan expression or levels in a sample. The assays can be performed in vitro or in vivo. By comparisons to a control or reference sample or classifications based on a predetermined level, such values can be used for diagnosis or prognosis of a hyaluronan-associated disease or condition, to predict responsiveness of a subject having a hyaluronan-associated disease or condition to a hyaluornan-degrading enzyme therapy, and/or to monitor or predict efficacy of treatment of a subject having a hyaluronan-associated disease or condition that has been treated with a hyaluronan-degrading enzyme therapy. For example, as described herein, it is found that HA levels and extent specifically are associated with responsiveness to treatment with a hyaluronan-degrading enzyme, such as a hyaluornidase or modified hyaluronidase (e.g. PEGylated hyaluronidase such as PEGPH20).

In any of the above examples, the hyaluronan-associated diseases or conditions are diseases and conditions in which hyaluronan levels are elevated as cause, consequence or otherwise observed in the disease or condition. Exemplary hyaluronan-associated diseases or conditions, include, but are not limited to, ones that are associated with high interstitial fluid pressure, a cancer and in particular a hyaluronan rich cancer, edema, disc pressure, an inflammatory disease, and other diseases associated with hyaluronan. In some cases, hyaluronan-associated diseases and conditions are associated with increased interstitial fluid pressure, decreased vascular volume, and/or increased water content in a tissue, such as a tumor. In particular, hyaluronan-associated diseases and conditions, include, but are not limited to, hyaluronan-rich cancers, for example, tumors, including solid tumors such as late-stage cancers, metastatic cancers, undifferentiated cancers, ovarian cancer, in situ carcinoma (ISC), squamous cell carcinoma (SCC), prostate cancer, pancreatic cancer, non-small cell lung cancer, breast cancer, colon cancer and other cancers.

In one example, based on the levels or expression of hyaluronan, a patient or subject can be selected for treatment with an anti-hyaluronan agent (e.g. a hyaluronan-degrading enzyme). For example, a sample from a subject can be contacted with a hyaluronan-binding protein (HABP) companion diagnostic, such as TSG-6-LM, a multimer or variant thereof, and the binding of the HABP to the sample can be detected in order to determine the amount of hyaluronan in the sample. Based on predetermined selection or classification criteria as described herein, a patient can be diagnosed with a hyaluronan-associated disease or condition, and hence selected for treatment of the disease or condition. Also, based on the predetermined selection or classification criteria as described herein, the methods herein can be used for prognosis of the subject. Depending on the course of the disease or condition, the dose, treatment schedule and/or dosing regime of the therapeutic agent (e.g. a hyaluronan-degrading enzyme) can be optimized and adjusted accordingly. In particular examples herein, based on the predetermined selection or classification criteria as described herein, a patient or subject can be selected for treatment that is predicted to be responsive to treatment with an anti-hyaluronan agent, for example a hyaluronan-degrading enzyme, such as a hyaluronidase or modified hyaluronidase (e.g. a PEGylated hyaluronidase such as PEGPH20). Hence, the method can be used to predict the efficacy of treatment by an anti-hyaluronan agent, for example a hyaluronan-degrading enzyme.

In examples of methods herein, the efficacy of the treatment by an anti-hyaluronan agent, for example a hyaluronan-degrading enzyme, can be determined by monitoring the expression or levels of hyaluronan over the course of treatment. Hence, the method is a post-treatment method of monitoring disease status and/or resolution, which information can be used to alter the course of treatment of a subject depending on individualized status information. For example, a sample from a subject can be contacted with a hyaluronan-binding protein (HABP) companion diagnostic, for example a TSG-6-LM, a multimer or variant thereof, and the binding of the HABP to the sample can be detected in order to determine the amount of hyaluronan in the sample. The expression or level of hyaluronan in the sample can be compared to a reference or control sample in order to assess differences in hyaluronan levels or expression. For example, elevated or accumulated hyaluronan levels in a diseased subject compared to a healthy or normal subject is indicative of a hyaluronan-associated disease or condition (e.g. tumor or cancer) and the extent of the hyaluronan expression or levels correlates to disease aggressiveness. In such methods, the control or reference sample is a sample from a healthy subject, is a baseline sample from the subject prior to treatment with an anti-hyaluronan agent (e.g. a hyaluronan-degrading enzyme) (pre-treatment reference) or is a sample from a subject prior to the last dose of an anti-hyaluronan agent (e.g. a hyaluronan-degrading enzyme). For example, for monitoring patient response, the assay can be run at the initiation of therapy to establish baseline (or predetermined) levels of hyaluronan in a sample (e.g. tissue or body fluid). The same sample (e.g. tissue or body fluid) is then sampled using the same assay and the levels of hyaluronan compared to the baseline or predetermined levels.

1. Assays for Measuring Hyaluronan

It is within the level of one of skill in the art to assess, quantify, determine and/or detect hyaluronan levels in a sample using an HABP companion diagnostic, such as TSG-6-LM, multimer (e.g. TSG-6LM-Fc) or variant thereof, as described herein. Assays include in vitro or in vivo assays. Exemplary binding assays that can be used to assess, evaluate, determine, quantify and/or otherwise specifically detect hyaluronan expression or levels in a sample include, but are not limited to, solid phase binding assays (e.g. enzyme linked immunosorbent assay (ELISA)), radioimmunoassay (RIA), immunoradiometric assay, fluorescence assay, chemiluminescent assay, bioluminescent assay, western blot and histochemistry methods, such as immunohistochemistry (IHC) or pseudo immunohistochemistry using a non-antibody binding agent. In solid phase binding assay methods, such as ELISA methods, for example, the assay can be a sandwich format or a competitive inhibition format. In other examples, in vivo imaging methods can be used.

a. Histochemical and Immunohistochemical Methods

The methods of assessing hyaluronan accumulation are based on the ability of an HABP companion diagnostic to bind to HA in a sample, for example a tissue or cell sample, such that the amount of the HABP companion diagnostic that binds correlates with amount of HA in the sample. Any HABP companion diagnostic provided herein can be used to detect HA using tissue staining methods known to one of skill in the art, including but not limited to, cytochemical or histochemical methods, such as immunohistochemistry (IHC) or histochemistry using a non-antibody binding agent (e.g. pseudo immunohistochemistry). Such histochemical methods permit quantitative or semi-quantitative detection of the amount of HABP that binds to HA in a sample, such as a tumor tissue sample. In such methods, a tissue sample can be contacted with an HABP reagent provided herein, and in particular one that is detectably labeled or capable of detection, under conditions that permit binding to tissue- or cell-associated HA.

A sample for use in the methods provided herein as determined by histochemistry can be any biological sample that can be analyzed for its HA levels, such as a tissue or cellular sample. For example, a tissue sample can be solid tissue, including a fresh, frozen and/or preserved organ or tissue sample or biopsy or aspirate, or cells. In some examples, the tissue sample is tissue or cells obtained from a solid tumor, such as primary and metastatic tumors, including but not limited to, breast, colon, rectum, lung, stomach, ovary, cervix, uterus, testes, bladder, prostate, thyroid and lung cancer tumors. In particular examples, the sample is a tissue sample from a cancer is a late-stage cancer, a metastatic cancer, undifferentiated cancer, ovarian cancer, in situ carcinoma (ISC), squamous cell carcinoma (SCC), prostate cancer, pancreatic cancer, non-small cell lung cancer, breast cancer, or colon cancer. In other examples, the tissue sample contains cells from primary or cultured cells or cell lines. Cells may be have various states of differentiation, and may be normal, pre-cancerous or cancerous, may be fresh tissues, dispersed cells, immature cells, including stem cells, cells of intermediate maturity and fully matured cells. Typically, the cells selected for use in the methods provided herein are cancer cells.

When the tumor is a solid tumor, isolation of tumor cells is typically achieved by surgical biopsy. Biopsy techniques that can be used to harvest tumor cells from a subject include, but are not limited to, needle biopsy, CT-guided needle biopsy, aspiration biopsy, endoscopic biopsy, bronchoscopic biopsy, bronchial lavage, incisional biopsy, excisional biopsy, punch biopsy, shave biopsy, skin biopsy, bone marrow biopsy, and the Loop Electrosurgical Excision Procedure (LEEP). Typically, a non-necrotic, sterile biopsy or specimen is obtained that is greater than 100 mg, but which can be smaller, such as less than 100 mg, 50 mg or less, 10 mg or less or 5 mg or less; or larger, such as more than 100 mg, 200 mg or more, or 500 mg or more, 1 gm or more, 2 gm or more, 3 gm or more, 4 gm or more or 5 gm or more. The sample size to be extracted for the assay can depend on a number of factors including, but not limited to, the number of assays to be performed, the health of the tissue sample, the type of cancer, and the condition of the subject. The tumor tissue is placed in a sterile vessel, such as a sterile tube or culture plate, and can be optionally immersed in an appropriate medium.

Tissue obtained from the patient after biopsy is often fixed, usually by formalin (formaldehyde) or glutaraldehyde, for example, or by alcohol immersion. For histochemical methods, the tumor sample can be processed using known techniques, such as dehydration and embedding the tumor tissue in a paraffin wax or other solid supports known to those of skill in the art (see Plenat et al., (2001) *Ann Pathol January* 21(1):29-47), slicing the tissue into sections suitable for staining, and processing the sections for staining according to the histochemical staining method selected, including removal of solid supports for embedding by organic solvents, for example, and rehydration of preserved tissue. Thus, samples for use in the methods herein can contain compounds that are not naturally present in a tissue or cellular sample, including for example, preservatives, anticoagulants, buffers, fixatives, nutrients and antibiotics.

In exemplary methods to select a subject for treatment with a hyaluronan-degrading enzyme, harvesting of the tumor tissue is generally performed prior to treatment of the subject with a hyaluronan-degrading enzyme. In exemplary methods of monitoring therapy of a tumor with a hyaluronan-degrading enzyme, harvesting of the tumor tissue from the subject can be performed before, during or after the subject has received one or more treatments with a hyaluronan-degrading enzyme.

Assays for use in the methods provided herein are those in which HA present in the sample is detected using histochemistry or immunohistochemistry. Histochemistry (HC) is a staining method based on enzymatic reactions using a binding partner, such as an antibody (e.g. monoclonal or polyclonal antibodies) or other binding partner, to detect cells or specific proteins such as tissue antigens, or biomarkers, for example, HA. For example, histochemistry assays for use in the methods herein include those where an HABP is used as a binding partner to detect HA associated with cells or tissues. Typically, histochemistry protocols include detection systems that make the presence of the markers visible, to either the human eye or an automated scanning system, for qualitative or quantitative analyses. In a direct HC assay, binding is determined directly upon binding of the binding partner (e.g. first antibody) to the tissue or biomarker due to the use of a labeled reagent. In an indirect HC assay, a secondary antibody or second binding partner is necessary to detect the binding of the first binding partner, as it is not labeled.

In such methods, generally a slide-mounted tissue sample is stained with a labeled binding reagent (e.g. labeled HABP) using common histochemistry techniques. Thus, in exemplary HC methods provided herein, the HABP companion diagnostics are modified to contain a moiety capable of being detected (as described in Section 3C above). In some examples, the HABP companion diagnostics are conjugated to small molecules, e.g., biotin, that are detected via a labeled binding partner or antibody. In some examples, the IHC method is based on staining with an HABP protein that is detected by enzymatic staining with horseradish peroxidase. For example, the HABP can be biotinylated and detected with avidin or streptavidin conjugated to detectable protein, such as streptavidin-horseradish peroxidase (see Example 6 below). In other examples, the HABP companion diagnostics are conjugated to detectable proteins which permit direct detection, such as, for example, HABP companion diagnostics conjugated to a fluorescent protein, bioluminescent protein or enzyme. Various enzymatic staining methods are known in the art for detecting a protein of interest. For example, enzymatic interactions can be visualized using different enzymes such as peroxidase, alkaline phosphatase, or different chromogens such as DAB, AEC or Fast Red. In other examples, the HABP companion diagnostics are conjugated to peptides or proteins that can be detected via a labeled binding partner or antibody.

In other examples, HA is detected by HC methods using a HABP companion diagnostic provided herein where the HABP companion diagnostics are detected by labeled secondary reagents, such as labeled antibodies that recognize one or more epitopes of the HABPs, HABP link domains, or HA binding fragments thereof. In other examples, HABP companion diagnostics are detected using an anti-HABP antibody. For detecting a HABP, any anti-HABP antibody can be used so long as it binds to the HABP, HABP link domain, or HA binding fragment thereof used to detect HA. For example, for detecting TSG-6 or a TSG-6-LM, an anti-TSG-6 link module monoclonal antibody can be used, such as antibodies designated A38 and Q75 (see, Lesley et al. (2002) *J Biol Chem* 277:26600-26608). The anti-HABP antibodies can be labeled for detection or can be detected with a secondary antibody that binds the first antibody. The selection of an appropriate anti-HABP antibody is within the level of one of skill in the art.

The resulting stained specimens are each imaged using a system for viewing the detectable signal and acquiring an image, such as a digital image of the staining. Methods for image acquisition are well known to one of skill in the art. For example, once the sample has been stained, any optical or non-optical imaging device can be used to detect the stain or biomarker label, such as, for example, upright or inverted optical microscopes, scanning confocal microscopes, cameras, scanning or tunneling electron microscopes, canning probe microscopes and imaging infrared detectors. In some examples, the image can be captured digitally. The obtained images can then be used for quantitatively or semi-quantitatively determining the amount of HA in the sample. Various automated sample processing, scanning and analysis systems suitable for use with immunohistochemistry are available in the art. Such systems can include automated staining and microscopic scanning, computerized image analysis, serial section comparison (to control for variation in the orientation and size of a sample), digital report generation, and archiving and tracking of samples (such as slides on which tissue sections are placed). Cellular imaging systems are commercially available that combine conventional light microscopes with digital image processing systems to perform quantitative analysis on cells and tissues, including immunostained samples. See, e.g., the CAS-200 system (Becton, Dickinson & Co.). In particular, detection can be made manually or by image processing techniques involving computer processors and software. Using such software, for example, the images can be configured, calibrated, standardized and/or validated based on factors including, for example, stain quality or stain intensity, using procedures known to one of skill in the art (see e.g. published U.S. patent Appl. No. US20100136549).

The image can be quantitatively or semi-quantitatively analyzed and scored based on staining intensity of the sample. Quantitative or semi-quantitative histochemistry refers to method of scanning and scoring samples that have undergone histochemistry, to identify and quantitate the presence of a specified biomarker, such as an antigen or other protein (e.g. HA). Quantitative or semi-quantitative methods can employ imaging software to detect staining densities or amount of staining or methods of detecting staining by the human eye, where a trained operator ranks results numerically. For example, images can be quantitatively analyzed using a pixel count algorithms (e.g. Aperio Spectrum Software, Automated QUantitatative Analysis platform (AQUA® platform), and other standard methods that measure or quantitate or semi-quantitate the degree of staining; see e.g. U.S. Pat. No. 8,023, 714; U.S. Pat. No. 7,257,268; U.S. Pat. No. 7,219,016; U.S. Pat. No. 7,646,905; published U.S. Pat. Appl. Nos. US20100136549 and 20110111435; Camp et al. (2002) Nature Medicine, 8:1323-1327; Bacus, et al. (1997) Analyt Quant Cytol Histol, 19:316-328). A ratio of strong positive stain (such as brown stain) to the sum of total stained area can be calculated and scored.

Using histochemical, such as immunohistochemical or pseudo immunohistochemical methods, the amount of HA detected is quantified and given as a percentage of HA positive pixels and/or a score. For example, the amount of HA detected in the sample can be quantified as a percentage of HA positive pixels. In some examples, the amount of HA present in a sample is quantified as the percentage of area stained, e.g., the percentage of HA positive pixels. For example, a sample can have at least or about at least or about 0, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 40%, 45%, 50%, 55%, 60%, 65%, 70%, 75%, 80%, 85%, 90%, 95% or more HA positive pixels as compared to the total staining area.

In some examples, a score is given to the sample that is a numerical representation of the intensity or amount of the histochemical staining of the sample, and represents the amount of target biomarker (e.g., HA) present in the sample. Optical density or percentage area values can be given a scaled score, for example on an integer scale, for example, 0-10, 0-5, or 0-3. In particular examples, the amount of hyaluronan in a sample is classified on a scale of 0-3, e.g. 0, $HA^{+1}$, $HA^{+2}$, and $HA^{+3}$. The amount of HA present is relative to the percentage of HA pixels, that is, low percentages of HA pixels indicates a low level of HA whereas high percentages of HA pixels indicate high levels of HA. Scores can correlated with percentages of HA positive pixels, such that the percentage area that is stained is scored as 0, $HA^{+1}$, $HA^{+2}$, and $HA^{+3}$, representing no staining, less than 10% staining, 10-25% staining or more than 25% staining respectively. For example, if the ratio (e.g. strong pixel stain to total stained area) is more than 25% the tumor tissue is scored as HA+3, if the ratio is 10-25% of strong positive stain to total stain the tumor tissue is scored as HA+2, if the ratio less than 10% of strong positive stain to total stain the tumor tissue is scored as HA+1, and if the ratio of strong positive stain to total stain is 0 the tumor tissue is scored as 0. A score of 0 or $HA^{+1}$ indicates low levels of HA in the tested sample, whereas a score of $HA^{+2}$ or $HA^{+3}$ indicates higher levels of HA in the tested samples.

b. Solid Phase Binding Assays

The methods of assessing hyaluronan accumulation are based on the ability of an HABP companion diagnostic to bind to HA in a sample such that the amount of the HABP companion diagnostic that binds correlates with amount of HA in the sample. In particular solid-phase binding assays can be used. Exemplary of binding assays that can be used to assess, evaluate, determine, quantify and/or otherwise specifically detect hyaluronan expression or levels in a sample include, but are not limited to, enzyme linked immunosorbent assay (ELISA), radioimmunoassay (RIA), immunoradiometric assay, fluoroassay, chemiluminescent assay, bioluminescent assay. For example, a HABP companion diagnostic provided herein can detect HA using any binding assay known to one of skill in the art, including but not limited to, enzyme-linked immunosorbent assay (ELISA) or other similar immunoassay, including a sandwich ELISA or competitive ELISA assay. Exemplary methods provided herein include ELISA based methods for quantitative or semi-quantitative detection of the amount of HABP that binds to HA in a sample, such as a tumor tissue sample or fluid sample from a subject having a tumor or suspected of having a tumor. The use of solid phase binding assays can be used when HA is detected in a bodily fluid.

As described herein, patients that exhibit high levels of hyaluronan production in the tumor tissue also exhibit high levels of hyaluronan in blood. Accordingly, the methods provided herein encompass methods of predicting the responsiveness of a subject to treatment with a hyaluronan-degrading enzyme, to select subjects for treatment with a hyaluronan-degrading enzyme, or to monitor treatment with a hyaluronan degrading enzyme, including assessing the accumulation of hyaluronan in a fluid sample from a patient having a tumor or a patient suspected of having a tumor.

Fluid samples for analysis of HA production in an HA-associated disease, such as cancer, include but are not limited to serum, urine, plasma, cerebrospinal fluid, and lymph. The subject can have or be suspected of having a cancer, such as a primary and metastatic tumors, in breast, colon, rectum, lung, stomach, ovary, cervix, uterus, testes, bladder, prostate, thyroid, lung cancer. In particular examples, the cancer is a late-stage cancer, a metastatic cancer, undifferentiated cancer, ovarian cancer, in situ carcinoma (ISC), squamous cell carcinoma (SCC), prostate cancer, pancreatic cancer, non-small cell lung cancer, breast cancer, or colon cancer.

In exemplary methods to predict the responsiveness of subject to treatment with a hyaluronan-degrading enzyme or to select subjects for treatment with a hyaluronan-degrading enzyme, collection of a fluid sample from a subject is generally performed prior to treatment of the subject with a hyaluronan-degrading enzyme. In exemplary methods of monitoring therapy of a tumor with a hyaluronan-degrading enzyme, collection of the fluid sample from a subject can be performed before, during or after the subject has received one or more treatments with a hyaluronan-degrading enzyme. Harvesting of the fluid sample also can be performed before, during, or after the subject has undergone one or more rounds of anti-cancer therapy, such as radiation and/or chemotherapy treatment.

The fluid sample then can be assessed for the presence or amount of HA using a solid-phase binding assay. Solid-phase binding assays can detect a substrate (e.g. HA) in a fluid sample by binding of the substrate to a binding agent that is fixed or immobilized to a solid surface. A substrate specific antibody or binding protein (e.g. an HABP provided herein), coupled to detectable label (e.g. an enzyme), is applied and allowed to bind to the substrate. Presence of the antibody or bound protein is then detected and quantitated. Detection and quantitation methods include, but are not limited to, colorimetric, fluorescent, luminescent or radioactive methods. The choice of detection method is dependent on the detectable label used. In some examples, a colorimetric reaction employing the enzyme coupled to the antibody. For example, enzymes commonly employed in this method include horseradish peroxidase and alkaline phosphatase. The amount of substrate present in the sample is proportional to the amount of color produced. A substrate standard is generally employed to improve quantitative accuracy. The concentration of HA in a sample can be calculated by interpolating the data to a standard curve. The amount of HA can be expressed as a concentration of fluid sample.

In an exemplary method, an HABP reagent that is generally unlabeled is first immobilized to a solid support (e.g. coated to wells of a microtiter plate), followed by incubation with a fluid sample containing HA (e.g. serum or plasma) to capture HA. After washing the fluid sample with an appropriate buffer, bound HA can be detected. In some examples to detect the bound HA, a second HABP that is the same or different than the immobilized HABP and that is labeled (labeled HABP), such as a biotinylated HABP, is used to bind to the HA on the plate. Following removal of the unbound labeled HABP, the bound labeled HABP is detected using a detection reagent. For example, biotin can be detected using an avidin detection reagent. In some examples, the HABP bound to the plate is different from the HABP used for detection. In other examples, the HABP bound to the plate and the HABP for detection are the same. In other examples to detect the bound HA, bound HA is detected by addition of HABP and subsequent addition of an anti-HABP antibody. For example, for detecting TSG-6 or a TSG-6-LM, an anti-TSG-6 link module monoclonal antibody can be used, such as antibodies designated A38 and Q75 (see, Lesley et al. (2002) *J Biol Chem* 277:26600-26608). The anti-HABP antibodies can be labeled for detection or can be detected with a secondary antibody that binds the first antibody. In yet other examples to detect the bound HA, bound HA is directly detected with an anti-HA antibody. Anti-HA antibodies are well known to one of skill in the art, and include, for example, a sheep anti-hyaluronic acid polyclonal antibody (e.g., Abcam #53842 or #93321).

c. In Vivo Imaging Assays

In some examples herein, the amount of HA is detected using in vivo imaging methods. In such methods, the HABP, such as a TSG-6-LM, multimer (e.g. TSG-6LLM-Fc) or variant thereof, is conjugated to a detectable moiety or moiety that is capable of detection by an imaging method. Exemplary imaging methods include, but are not limited to, fluorescence imaging, X-rays, magnetic resonance methods, such as magnetic resonance imaging (MRI) and magnetic resonance spectroscopy (MRS), and tomographic methods, including computed tomography (CT), computed axial tomography (CAT), electron beam computed tomography (EBCT), high resolution computed tomography (HRCT), hypocycloidal tomography, positron emission tomography (PET), single-photon emission computed tomography (SPECT), spiral computed tomography and ultrasonic tomography. For example, for fluorescence imaging, fluorescent signals can be analyzed using a fluorescent microscope or fluorescence stereomicroscope. Also, a low light imaging camera also can be used.

In particular, the HABP, such as a TSG-6-LM, multimer (e.g. TSG-6LLM-Fc) or variant thereof, is labeled or conjugated with a moiety that provides a signal or induces a signal that is detectable in vivo, when imaged, such as, but not limited to, magnetic resonance imaging (MRI), single-photon emission computed tomography (SPECT), positron emission tomography (PET), scintigraphy, gamma camera, β+ detector, a γ detector, fluorescence imaging and bioluminescence imaging. Exemplary imaging/monitoring methods include any of a variety magnetic resonance methods such as magnetic resonance imaging (MRI) and magnetic resonance spectroscopy (MRS), and also include any of a variety of tomographic methods including computed tomography (CT), computed axial tomography (CAT), electron beam computed tomography (EBCT), high resolution computed tomography (HRCT), hypocycloidal tomography, positron emission tomography (PET), gamma rays (after annihilation of a positron and an electron in PET scanning), single-photon emission computed tomography (SPECT), spiral computed tomography and ultrasonic tomography. Other exemplary imaging methods include low-light imaging, X-rays, ultrasound signal, fluorescence absorption and bioluminescence. In addition, the proteins can be labeled with light-emitting or other electromagnetic spectrum-emitting compounds, such as fluorescent compounds or molecules. Detection can be effected by detecting emitted light or other emitted electromagnetic radiation.

Detectable labels include reagents with directly detectable elements (e.g. radiolabels) and reagents with indirectly detectable elements (e.g. a reaction product). Section C.3.c also describes detectable labels. Examples of detectable labels include radioisotopes, bioluminescent compounds, chemiluminescent compounds, fluorescent compounds, metal chelates and enzymes. A detectable label can be incorporated into an HABP by chemical or recombinant methods.

Labels appropriate for X-ray imaging are known in the art, and include, for example, Bismuth (III), Gold (III), Lanthanum (III) or Lead (II); a radioactive ion, such as 67Copper, 67Gallium, 68Gallium, 111Indium, 113Indium, 123Iodine, 125Iodine, 131Iodine, 197Mercury, 203Mercury, 186Rhenium, 188Rhenium, 97Rubidium, 103Rubidium, 99Technetium or 90Yttrium; a nuclear magnetic spin-resonance isotope, such as Cobalt (II), Copper (II), Chromium (III), Dysprosium (III), Erbium (III), Gadolinium (III), Holmium (III), Iron (II), Iron (III), Manganese (II), Neodymium (III), Nickel (II), Samarium (III), Terbium (III), Vanadium (II) or Ytterbium (III); or rhodamine or fluorescein.

Contrast agents are used for magnetic resonance imaging. Exemplary contrast agents include iron, gold, gadolinium and gallium. Labels appropriate for magnetic resonance imaging are known in the art, and include, for example, fluorine, gadolinium chelates, metals and metal oxides, such as for example, iron, gallium, gold, gadolinium, magnesium, $^{1}$H, $^{19}$F, $^{13}$C, and $^{15}$N labeled compounds. Use of chelates in contrast agents is known in the art. Labels appropriate for tomographic imaging methods are known in the art, and include, for example, β-emitters such as $^{11}$C, $^{13}$N, $^{15}$O or $^{64}$Cu or (b) γ-emitters such as $^{123}$I. Other exemplary radionuclides that can, be used, for example, as tracers for PET include $^{55}$Co, $^{67}$Ga, $^{68}$Ga, $^{60}$Cu(II), $^{67}$Cu(II), $^{99}$Tc, $^{57}$Ni, $^{52}$Fe and $^{18}$F. The reagent, such as TSG-6 or the FC portion thereof can be conjugated to a suitable label and/or the protein can include a radiolabel in its constituent molecules.

An exemplary list of radionuclides useful for the imaging methods provided herein includes, for example, $^{11}$Carbon, $^{11}$Fluorine, $^{13}$Carbon, $^{13}$Nitrogen, $^{15}$Nitrogen, $^{15}$Oxygen, $^{18}$Flourine, $^{19}$Flourine, $^{24}$Sodium, $^{32}$Phosphate, $^{42}$Potassium, $^{51}$Chromium, $^{55}$Iron, $^{59}$Iron, $^{57}$Cobalt, $^{60}$Cobalt, $^{64}$Copper, $^{67}$Gallium, $^{68}$Gallium, $^{75}$Selenium, $^{81}$Krypton, $^{82}$Rubidium, $^{89}$Strontium, $^{92}$Strontium, $^{90}$Yttrium, $^{99}$Technetium, $^{103}$Palladium, $^{106}$Ruthenium, $^{111}$Indium, $^{117}$Lutetium, $^{123}$Iodine, $^{125}$Iodine, $^{131}$Iodine, $^{133}$Xenon, $^{137}$Cesium, $^{153}$Samarium, $^{153}$Gadolinium, $^{165}$Dysprosium, $^{166}$Holmium, $^{169}$Ytterbium, $^{177}$Leutium $^{186}$Rhenium, $^{188}$Rhenium, $^{192}$Iridium, $^{198}$Gold, $^{201}$Thallium, $^{211}$Astatine, $^{212}$Bismuth and $^{213}$Bismuth. One of skill in the art can alter the parameters used in different imaging methods (MRI, for example) in order to visualize different radionuclides/metals.

Fluorescent labels also can be used. These include fluorescent proteins, fluorescent probes or fluorescent substrate. For example, fluorescent proteins can include, but are not limited to, fluorescent proteins such as green fluorescent protein (GFP) or homologs thereof or RFP; fluorescent dyes (e.g., fluorescein and derivatives such as fluorescein isothiocyanate (FITC) and Oregon Green®, rhodamine and derivatives (e.g., Texas red and tetramethyl rhodamine isothiocyanate (TRITC)), biotin, phycoerythrin, AMCA, Alexa Fluor®, Li-COR®, CyDyes® or DyLight® Fluors); tdTomato, mCherry, mPlum, Neptune, TagRFP, mKate2, TurboRFP and TurboFP635 (Katushka). The fluorescent reagent can be chosen based on user desired excitation and emission spectra. Fluorescent substrates also can be used that result in fluorescent cleavage products.

The in vivo imaging methods can be used in the diagnosis of HA-associated tumors or cancers. Such a technique permits diagnosis without the use of biopsy. In vivo imaging methods based on the extent or level of binding of an HABP to a tumor also can be used for prognoses to cancer patients. The in vivo imaging methods also can be used to detect metastatic cancers in other parts of the body or circulating tumor cells (CTCs). It is within the level of one of skill in the art to ascertain background levels of hyaluronan in tissues other than tumors. Hyaluronan-expressing tumors will have higher levels of signal than background tissues. In some examples, a-threshold criteria can be determined by comparisons to signal detected in normal or healthy subjects.

2. Classification of Subjects

Once the amount of hyaluronan in the sample is determined, the amount can be compared to a control or threshold level. The control or threshold level is generally a predetermined threshold level or amount that is indicative of a hyaluronan-associated disease or condition (e.g. a tumor or cancer). Such level or amount can be empirically determined by one skilled in the art. It is understood that the particular predetermined selection or classification criteria for the methods herein are dependent on the particular assay that is used to detect hyaluronan and the particular sample that is being tested. It is within the level of one of skill in the art to determine if an assay is compatible with testing a particular sample. Generally, in vitro solid phase assays are used for testing body fluid samples. Solid phase assays such as histochemistry or immunohistochemistry are generally used for testing tissue samples. It also is understood that in methods involving comparisons to a predetermined level or amount or to a control or reference sample that the references are made with the same type of sample and using the same assay and HABP reagent (including the same detectable moiety and detecting method).

For example, the predetermined threshold level can be determined based on the level or amount of the marker in a reference or control sample, such as the median or mean level or amount of the marker in a population of subjects, in order to assess differences in levels or expression. In one example, the predetermined threshold level can represent the mean or median level or amount of hyaluronan in a sample from a healthy subject or a subject known to have a hyaluronan-associated disease or condition (e.g. a tumor or cancer). In one embodiment, the predetermined level or amount of hyaluronan from a normal tissue or bodily fluid sample is the mean level or amount observed in normal samples (e.g., all normal samples analyzed). In another embodiment, the level or amount of hyaluronan from a normal tissue or bodily fluid sample is the median value for the level or amount observed in normal samples. The predetermined threshold level also can be based on the level or amount of hyaluronan in a cell line or other control sample (e.g. tumor cell line). As described below, these predetermined values can be determined by comparison or knowledge of HA levels in a corresponding normal sample as determined by the same assay of detection and using the same HABP reagent.

The reference or control sample can be another tissue, cell or body fluid, such as a normal tissue, cell or body fluid, for example, a tissue, cell or body fluid that is analogous to the sample being tested, but isolated from a different subject. The control or reference subject can be a subject or a population of subjects that is normal (i.e. does not have a disease or condition), a subject that has a disease but does not have the type of disease or condition that the subject being tested has or is suspected of having, for example, a subject that does not have a hyaluronan-associated disease or condition (e.g. a tumor or cancer), or an analogous tissue from another subject that has a similar disease or condition, but whose disease is not as severe and/or expresses relatively less hyaluronan. For example, when the cell, tissue or fluid being tested is a subject or a population of subjects having a cancer, the level or amount of the marker can be compared to the level or amount of the marker in a tissue, cell or fluid from a subject having a less severe cancer, such as an early stage, differentiated or other type of cancer. In another example, a control or reference sample is a fluid, tissue, extract (e.g. cellular or nuclear extract), nucleic acid or peptide preparation, cell line, biopsy, standard or other sample, with a known amount or relative amount of hyaluronan, such as a sample, for example a tumor cell line, known to express relatively low levels of HA, such as exemplary tumor cell lines that express low levels of HA, for example, the HCT 116 cell line, the HT29 cell line, the NCI H460 cell line, the DU145 cell line, the Capan-1 cell line, and tumors from tumor models generated using such cell lines.

In any method herein, the level(s) of hyaluronan in samples from subjects suspected or known to have a hyaluronan-associated disease or condition (e.g., cancer) can be determined concurrently with the determination of level(s) of hyaluronan in reference or normal tissues. Alternatively, the levels of hyaluronan in samples from subjects suspected or known to have a hyaluronan-associated disease or condition (e.g. cancer) can be compared to the level(s) of hyaluronan previously determined in normal tissue or bodily fluid. Thus, the level of hyaluronan in normal or healthy samples or other reference samples employed in any detection, comparison, determination, or evaluation can be a level or amount determined prior to any detection, determination, or evaluation of the level or amount of hyaluronan in a sample from a human patient.

The level or amount of hyaluronan is determined and/or scored and compared to predetermined phenotypes of hyaluronan associated with disease. It is within the level of one of skill in the art to determine the threshold level for disease diagnosis depending on the particular disease, the assay being used for detection of the hyaluronan and/or the HABP detection reagent being used. It is within the level of one of skill in the art to determine the threshold level of the hyaluronan for classifying responsiveness to treatment with an anti-hyaluronan agent (e.g. a hyaluronan-degrading enzyme). Exemplary methods for stratification of tumor samples or bodily fluid samples for diagnosis, prognosis or selection of subjects for treatment are provided herein.

It is understood that the particular change, e.g. increase in or decrease of hyaluronan is dependent on the assay used. In an ELISA, the fold increase or decrease in absorbance at a particular wavelength or in quantity of protein (e.g. as determined by using a standard curve) can be expressed relative to a control. In a PCR assay, such as RT-PCR, expression levels can be compared to control expression levels (e.g. expressed as fold change) using methods known to those in the art, such as using standards.

In particular examples of the methods herein, a subject is selected as a candidate for therapy with an anti-hyaluronan agent if the amount of hyaluronan is determined to be elevated in the sample. For example, elevated or accumulated hyaluronan levels in a diseased subject compared to a healthy or normal subject is indicative of a hyaluronan-associated disease or condition (e.g. tumor or cancer). The hyaluronan can be elevated 0.5-fold, 1-fold, 2-fold, 3-fold, 4-fold, 5-fold, 6-fold, 7-fold, 8-fold, 9-fold, 10-fold or more. Thus, in examples of the methods herein, when the amount of hyaluronan in a sample from a subject is being tested, detection of the marker can be determining that the amount of HA in the sample (e.g. cancerous cell, tissue or fluid) from the subject is elevated compared to a predetermined level or amount or control sample. In one example, the subject is determined to have a hyaluronan-associated disease or condition if the amount of HA in the tissue, cell or fluid is elevated at or about 0.5-fold, 1-fold, 2-fold, 3-fold, 4-fold, 5-fold, 6-fold, 7-fold, 8-fold, 9-fold, 10-fold, 11-fold, 12-fold, 13-fold, 14-fold, 15-fold, 20-fold, or more, compared to the predetermined level or amount or control sample.

A subject can be selected as a candidate for therapy with an anti-hyaluronan agent (e.g. a hyaluronan-degrading enzyme) based on the level or amount of hyaluronan in a sample (e.g. a bodily fluid or other fluid) from the subject. HA greater than 0.010 µg/mL, 0.015 µg/mL, and generally greater than 0.02 µg/mL, 0.03 µg/mL, 0.04 µg/mL, 0.05 µg/mL, 0.06 µg/mL or higher correlates to the presence of a tumor or cancer. Using such methods, in exemplary methods provided herein, a subject can be selected for treatment with a an anti-hyaluronan agent (e.g. hyaluronan-degrading enzyme) if the concentration of HA in the fluid sample, such as a serum sample, contains HA levels greater than 0.010 µg/mL, 0.015 µg/mL, and generally greater than 0.02 µg/mL, 0.03 µg/mL, 0.04 µg/mL, 0.05 µg/mL, 0.06 µg/mL or higher.

A subject can be selected as a candidate for therapy with an anti-hyaluronan agent (e.g. a hyaluronan-degrading enzyme) based on the level or amount of hyaluronan in a cell or tissue sample. In such an example, if the level is indicative of disease, then the patient is diagnosed with a hyaluronan-associated disease or condition. For example, using immunohistochemistry methods of tumor tissues a score of $HA^{+2}$ or $HA^{+3}$ can be determinative of disease. For example, a percentage of staining of HA over total tumoral area of greater than 10%, such as 10 to 25%, or greater than 25% is indicative of disease. In the methods herein, a subject is selected for treatment with an anti-hyaluronan agent (e.g. a hyaluronan-degrading enzyme) if the scaled score of the sample is an $HA^{+2}$ or $HA^{+3}$ sample. For example, a high score, e.g., $HA^{+3}$, indicates the subject has a HA-rich tumor indicative of the presence of a tumor that would benefit from treatment with an anti-hyaluronan agent (e.g. a hyaluronan-degrading enzyme) and thus is a candidate for therapy with an anti-hyaluronan agent (e.g. a hyaluronan-degrading enzyme). In other examples, a subject can be selected for treatment with an anti-hyaluronan agent (e.g. a hyaluronan-degrading enzyme) based on the percentage of staining, for example, if the degree of HA staining is 10%, 15%, 20%, 25%, 30%, 35%, 40%, 45%, 50%, 55%, 60%, 65%, 70%, 75%, 80%, 85%, 90%, 95% or more of the total staining area, and generally at least 25% or more.

Efficacy of treatment with an anti-hyaluronan agent (e.g. a hyaluronan-degrading enzyme) or responsiveness to treatment also can be monitored by comparing the level or amount of hyaluronan in a subject over time. Changes in the level or amount of hyaluronan can be used to optimize dosing or scheduling of treatment with an anti-hyaluronan agent (e.g. a hyaluronan-degrading enzyme). In the method, the level of HA expression in samples, in particular as assessed in tumor tissues (e.g. via immunohistochemistry or other similar method), from treated subjects are compared to a predetermined level of HA expression. For purposes of monitoring treatment after administration of a hyaluronan-degrading enzyme, in particular one with an extended half-life (e.g. PEGPH20), the sample that is monitored is not a bodily fluid in which systemic levels of enzyme can be present.

For purposes of monitoring treatment, the predetermined level of HA can be from a normal or healthy subject, a baseline HA value prior to treatment, the prior measured HA level in the same subject at an earlier time after treatment, or a classification or stratification of HA levels known to be associated with disease progression or regression. For example, if the hyaluronan level is about the same as or below (or decreased) as compared reference or control sample, the treatment is likely efficacious and the treatment can be continued or discontinued or altered. For example, the predetermined level of HA can be an HA level from a normal or healthy tissue sample, and if the level of HA measured in the subject after treatment is higher than the normal HA levels, then treatment is resumed or continued. For example, the predetermined level of HA can be HA levels as determined from a baseline HA value prior to treatment, and the course of treatment determined accordingly. For example, if the level of HA is the same as baseline HA than treatment is continued or resumed; if the level of HA is higher than baseline HA then treatment is continued or resumed or treatment is accelerated or increased (e.g. by increasing the dosage of hyaluronan-degrading enzyme or increasing the dose schedule in a dosage regimen cycle); if the level of HA is less than baseline HA then treatment is continued or resumed, terminated or is reduced or decreased (e.g. by decreasing the dosage of hyaluronan-degrading enzyme or decreasing the dose schedule in a dosage regimen cycle). In a further example, the predetermined level of HA can be an HA level as determined in a prior measurement in an earlier course of treatment of the same subject. For example, if the level of HA is the same as the earlier measured HA, then treatment is continued or resumed; if the level of HA is higher than the earlier measured HA, then treatment is continued or resumed or treatment is accelerated or increased (e.g. by increasing the dosage of hyaluronan-degrading enzyme or increasing the dose schedule in a dosage regimen cycle); if the level of HA is less than the earlier measured HA, then treatment is continued or resumed, terminated or is reduced or decreased (e.g. by decreasing the dosage of hyaluronan-degrading enzyme or decreasing the dose schedule in a dosage regimen cycle).

In the monitoring methods or methods of determining efficacy of treatment, the particular therapy can be altered during the course of treatment to maximize individual response. Dosing and scheduling of treatment can be modified in response to changing levels. Combination therapy using other anti-cancer agents also can be employed in such treatment methods. It is within the level of the skill of the treating physician to determine the exact course of treatment. For example, the treatment can be altered, such that the dosing amount, schedule (e.g freqency of administration), or regime is adjusted accordingly, such as discontinued, decreased or made less frequent, or combined with another treatment for the disease or condition. On the other hand, if the hyaluronan level is above a compared reference or control sample, the patient is likely not responding to the treatment. In such instances, the particular nature and type of anti-hyaluronan agent (e.g. hyaluronan-degrading enzyme) or combination therapy can be modified or changed. In other instances, the dosing, amount, schedule and/or regime can be adjusted accordingly, such as increased or made more frequent. It is within the level of the treating physician to determine the exact course of treatment.

For purposes of monitoring efficacy of treatment, predetermined levels or amounts of hyaluronan can be empirically determined, whereby the level or amount indicates that the treatment is working. These predetermined values can be determined by comparison or knowledge of HA levels in a corresponding normal sample or samples of disease subjects as determined by the same assay of detection and using the same HABP reagent. For example, high levels of HA as assessed by immunohistochemistry methods using a quantitative score scheme (e.g. $HA^{+3}$) or percentage of tumor staining for hyaluronan of greater than 25% correlate to the existence of malignant disease across a range of cancer types, and indicate that a patient is not responding to treatment. In another example, HA levels in bodily fluid such as plasma of greater than 0.015 µg/mL, and generally greater than 0.02 µg/mL, such as 0.03 µg/mL, 0.04 µg/mL, 0.05 µg/mL or 0.06 µg/mL HA, is associated with advanced disease stage. On the other hand, a subject is likely responding to treatment if the scaled score of the sample is less than an $HA^{+2}$ or $HA^{+3}$ or the percentage of HA staining is less than 25%, 20%, 15%, 10%, 9%, 8%, 7%, 6%, 5%, 4%, 3%, 2% or less. A subject is likely responding to treatment if the HA level in bodily fluid such as plasma is less than 0.03 µg/mL, 0.02 µg/mL, 0.01 µg/mL or less.

In the methods herein, the comparison to a predetermined level or to levels of a control or reference sample can be determined by any method known of skill in the art. For example, the comparison of the level of hyaluronan with a reference, control or predetermined level can be done by an automated system, such as software program or intelligence system that is part of, or compatible with, the equipment (e.g. computer platform) on which the assay is carried out. Alternatively, this comparison can be done by a physician or other trained or experienced professional or technician.

E. TREATMENT OF SELECTED SUBJECTS WITH AN ANTI-HYALURONAN AGENT

The methods provided herein include methods of treating a tumor-bearing subject with an anti-hyaluronan agent, for example a hyaluronan-degrading enzyme, where the subject has been selected for treatment based on level of HA detected in the tumor. The methods of treatment also include methods for assessing effects of treatment with an anti-hyaluronan agent, for example a hyaluronan-degrading enzyme, such as efficacy of treatment, such as for example, tumor inhibition or regression, or side effects of treatment, such as for example, musculoskeletal side effects. Combination therapies with one or more additional anti-cancer agents or one more agents to treat one or more side effects of therapy with an anti-hyaluronan agent (e.g. a hyaluronan-degrading enzyme) also are provided.

1. Anti-Hyaluronan Agent

Anti-hyaluronan agents include agents that inhibit hyaluronan synthesis or degrade hyaluronan. Anti-hyaluronan agents, such as hyaluronan degrading enzymes, can be used to treat a hyaluronan-associated disease or condition, including tumors and cancers or inflammatory diseases or conditions. For example, HA accumulation, such as by altered hyaluronan metabolism, distribution and function is associated with arthritis, immune and inflammatory disorders, pulmonary and vascular diseases and cancer (Morohashi et al. (2006) *Biochem. Biophys. Res. Comm.,* 345:1454-1459). Such diseases can be treated by inhibiting HA synthesis or degrading HA (see e.g. Morohashi 2006; U.S. published application No. 20100003238 and International published PCT Appl. No WO 2009/128917). In some examples, such treatments that reduce hyaluronan levels on cells and tissues can be associated with adverse side effects, such as musculoskeletal side effects. Hence, treatment with an anti-hyaluronan-agent can further include treatment with a corticosteroid to ameliorate or reduce such side effects.

a. Agents that Inhibit Hyaluronan Synthesis

HA can be synthesized by three enzymes that are the products of three related mammalian genes identified as HA synthases, designated has-1, has-2 and has-3. Different cell types express different HAS enzymes and expression of HAS mRNAs is correlated with HA biosynthesis. It is known that silencing HAS genes in tumor cells inhibits tumor growth and metastasis. An anti-hyaluronan agent includes any agent that inhibits, reduces or downregulates the expression or level of an HA synthase. Such agents are known to one of skill in the art or can be identified.

For example, downregulation of a HAS can be accomplished by providing oligonucleotides that specifically hybridize or otherwise interact with one or more nucleic acid molecules encoding an HAS. For example, anti-hyaluronan agents that inhibit hyaluronan synthesis include antisense or sense molecules against an has gene. Such antisense or sense inhibition is typically based upon hydrogen bonding-based hybridization of oligonucleotide strands or segments such that at least one strand or segment is cleaved, degraded or otherwise rendered inoperable. In other examples, post-transcriptional gene silencing (PTGS), RNAi, ribozymes and DNAzymes can be employed. It is within the level of one skill in the art to generate such constructs based on the sequence of HAS1 (set forth in SEQ ID NO:219), HAS2 (set forth in SEQ ID NO:220) or HAS3 (set forth in SEQ ID NO:221). It is understood in the art that the sequence of an antisense or sense compound need not be 100% complementary to that of its target nucleic acid to be specifically hybridizable. Moreover, an oligonucleotide can hybridize over one or more segments such that intervening or adjacent segments are not involved in the hybridization event (e.g. a loop structure or hairpin structure). Generally, the antisense or sense compounds have at least 70% sequence complementarity to a target region within the target nucleic acid, for example, 75% to 100% complementarity, such as 75%, 80%, 85%, 90%, 95% or 100%. Exemplary sense or antisense molecules are known in the art (see e.g. Chao et al. (2005) *J. Biol. Chem.*, 280:27513-27522; Simpson et al. (2002) *J. Biol. Chem.*, 277:10050-10057; Simpson et al. (2002) *Am. J. Path.*, 161:849; Nishida et al. (1999) *J. Biol. Chem.*, 274:21893-21899; Edward et al. (2010) *British J Dermatology*, 162:1224-1232; Udabage et al. (2005) *Cancer Res.*, 65:6139; and published U.S. Patent application No. US20070286856).

Another exemplary anti-hyaluronan agent that is an HA synthesis inhibitor is 4-Methylumbelliferone (4-MU; 7-hydroxy-4-methylcoumarin) or a derivative thereof. 4-MU acts by reducing the UDP-GlcUA precursor pool that is required for HA synthesis. For example, in mammalian cells, HA is synthesized by HAS using UDP-glucuronic acid (UGA) and UDP-N-acetyl-D-glucosamine precursors. 4-MU interferes with the process by which UGA is generated, thereby depleting the intracellular pool of UGA and resulting in inhibition of HA synthesis. 4-MU is known to have antitumor activity (see e.g. Lokeshwar et al. (2010) *Cancer Res.*, 70:2613-23; Nakazawa et al. (2006) *Cancer Chemother. Pharmacol.*, 57:165-170; Morohashi et al. (2006) *Biochem. Biophys. Res. Comm.*, 345-1454-1459). Oral administration of 4-MU at 600 mg/kg/d reduces metastases by 64% in the B16 melanoma model (Yoshihara et al. (2005) *FEBS Lett.*, 579:2722-6). The structure of 4-MU is set forth below. Also, derivatives of 4-MU exhibit anti-cancer activity, in particular 6,7-dihydrozy-4-methyl coumarin and 5,7-dihydroxy-4-methyl coumarin (see e.g. Morohashi et al. (2006) *Biochem. Biophys. Res. Comm.*, 345-1454-1459).

4-Methylumbelliferone (4-MU; $C_{10}H_8O_3$)

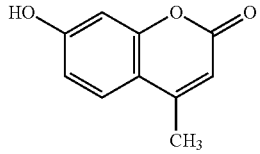

Further exemplary anti-hyaluronan agents are tyrosine kinase inhibitors, such as Leflunomide (Arava), genistein or erbstatin. Leflunomide also is a pyrimidine synthesis inhibitor. Leflunomide is a known drug for the treatment of Rheumatoid arthritis (RA), and also is effective in treating the rejection of allografts as well as xenografts. HA is known to directly or indirectly contribute to RA (see e.g. Stuhlmeier (2005) *J Immunol.*, 174:7376-7382). Tyrosine kinase inhibitors inhibit HAS1 gene expression (Stuhlmeier 2005).

In one example, leflunomide, or derivatives thereof, generally are available as tablets containing 1-100 mg of active drug, for example, 1, 5, 10, 20, 30, 40, 50, 60, 70, 80, 90 or 100 mg of drug. For the treatment of a hyaluronan-associated disease and conditions, for example Rheumatoid arthritis or a tumor or cancer, it is administered at 10 to 500 mg per day, typically 100 mg per day. The dosage can be continued as needed for treatment of the disease or conditions, or can be tapered or reduced to successively lower doses. For example, for treatment of Rheumatoid arthritis, leflunomide can be administered at an initial loading dose of 100 mg per day for three days and then administered at a continued dose of 20 mg/day.

b. Hyaluronan-Degrading Enzymes

Hyaluronan is an essential component of the extracellular matrix and a major constituent of the interstitial barrier. By catalyzing the hydrolysis of hyaluronan, hyaluronan-degrading enzymes lower the viscosity of hyaluronan, thereby increasing tissue permeability and increasing the absorption rate of fluids administered parenterally. As such, hyaluronan-degrading enzymes, such as hyaluronidases, have been used, for example, as spreading or dispersing agents in conjunction with other agents, drugs and proteins to enhance their dispersion and delivery.

Hyaluronan degrading enzymes act to degrade hyaluronan by cleaving hyaluronan polymers, which are composed of repeating disaccharides units, D-glucuronic acid (GlcA) and N-acetyl-D-glucosamine (GlcNAc), linked together via alternating $\beta$-1→4 and $\beta$-1→3 glycosidic bonds. Hyaluronan chains can reach about 25,000 disaccharide repeats or more in length and polymers of hyaluronan can range in size from about 5,000 to 20,000,000 Da in vivo. Accordingly, hyaluronan degrading enzymes for the uses and methods provided include any enzyme having the ability to catalyze the cleavage of a hyaluronan disaccharide chain or polymer. In some examples the hyaluronan degrading enzyme cleaves the $\beta$-1→4 glycosidic bond in the hyaluronan chain or polymer. In other examples, the hyaluronan degrading enzyme catalyze the cleavage of the $\beta$-1→3 glycosidic bond in the hyaluronan chain or polymer.

Hence, hyaluronan degrading enzymes, such as hyaluronidases, are a family of enzymes that degrade hyaluronic acid, which is an essential component of the extracellular matrix and a major constituent of the interstitial barrier. By catalyzing the hydrolysis of hyaluronic acid, a major constituent of the interstitial barrier, hyaluronan degrading enzymes lower the viscosity of hyaluronic acid, thereby increasing tissue permeability. As such, hyaluronan degrading enzymes, such as hyaluronidases, have been used, for example, as a spreading or dispersing agent in conjunction with other agents, drugs and proteins to enhance their dispersion and delivery. Hyaluronan-degrading enzymes also are used as an adjuvant to increase the absorption and dispersion of other injected drugs, for hypodermoclysis (subcutaneous fluid administration), and as an adjunct in subcutaneous urography for improving resorption of radiopaque agents. Hyaluronan-degrading enzymes, for example, hyaluronidase can be used in applications of ophthalmic procedures, for example, peribulbar and sub-Tenon's block in local anesthesia prior to ophthalmic surgery. Hyaluronidase also can be used in other therapeutic and cosmetic uses, for example, by promoting akinesia in cosmetic surgery, such as blepharoplasties and face lifts.

Various forms of hyaluronan degrading enzymes, including hyaluronidases have been prepared and approved for therapeutic use in subjects, including humans. The provided compositions and methods can be used, via these and other therapeutic uses, to treat hyaluronan-associated diseases and conditions. For example, animal-derived hyaluronidase preparations include Vitrase (ISTA Pharmaceuticals), a purified ovine testicular hyaluronidase, Amphadase (Amphastar Pharmaceuticals), a bovine testicular hyaluronidase and Hydase (Prima Pharm Inc.), a bovine testicular hyaluronidase. It is understood that any animal-derived hyaluronidase preparation can be used in the methods and uses provided herein (see, e.g., U.S. Pat. Nos. 2,488,564, 2,488,565, 2,676,139, 2,795,529, 2,806,815, 2,808,362, 5,747,027 and 5,827,721 and International PCT Application No. WO2005/118799). Hylenex (Halozyme Therapeutics) is a human recombinant hyaluronidase produced by genetically engineered Chinese Hamster Ovary (CHO) cells containing nucleic acid encoding soluble forms of PH20, designated rHuPH20.

Exemplary of hyaluronan degrading enzymes in the compositions and methods provided herein are soluble hyaluronidases. Other exemplary hyaluronan degrading enzymes include, but are not limited to particular chondroitinases and lyases that have the ability to cleave hyaluronan.

As described below, hyaluronan-degrading enzymes exist in membrane-bound or soluble forms that are secreted from cells. For purposes herein, soluble hyaluronan-degrading enzymes are provided for use in the methods, uses, compositions or combinations herein. Thus, where hyaluronan-degrading enzymes include a glycosylphosphatidylinositol (GPI) anchor and/or are otherwise membrane-anchored or insoluble, such hyaluronan-degrading enzymes are provided herein in soluble form by truncation or deletion of the GPI anchor to render the enzyme secreted and soluble. Thus, hyaluronan-degrading enzymes include truncated variants, e.g. truncated to remove all or a portion of a GPI anchor. Hyaluronan-degrading enzymes provide herein also include allelic or species variants or other variants, of a soluble hyaluronan-degrading enzyme. For example, hyaluronan degrading enzymes can contain one or more variations in its primary sequence, such as amino acid substitutions, additions and/or deletions. A variant of a hyaluronan-degrading enzyme generally exhibits at least or about 60%, 70%, 80%, 90%, 91%, 92%, 93%, 94%, 95%, 96%, 97%, 98%, 99% or more sequence identity compared to the hyaluronan-degrading enzyme not containing the variation. Any variation can be included in the hyaluronan degrading enzyme for the purposes herein provided the enzyme retains hyaluronidase activity, such as at least or about 5%, 10%, 15%, 20%, 25%, 30%, 35%, 40%, 45%, 50%, 55%, 60%, 65%, 70%, 75%, 80%, 85%, 90%, 95% or more of the activity of a hyaluronan degrading enzyme not containing the variation (as measured by in vitro and/or in vivo assays well known in the art and described herein).

Where the methods and uses provided herein describe the use of a soluble hyaluronidase, accordingly any hyaluronan degrading enzyme, generally a soluble hyaluronan degrading enzyme, can be used. It is understood that any hyaluronidase can be used in the methods and uses provided herein (see, e.g., U.S. Pat. No. 7,767,429 and U.S. Publication Nos. US20040268425 and US20100143457).

i. Hyaluronidases

Hyaluronidases are members of a large family of hyaluronan degrading enzymes. There are three general classes of hyaluronidases: mammalian-type hyaluronidases, bacterial hyaluronidases and hyaluronidases from leeches, other parasites and crustaceans. Such enzymes can be used in the compositions, combinations and methods provided herein.

(1) Mammalian-Type Hyaluronidases

Mammalian-type hyaluronidases (EC 3.2.1.35) are endo-β-N-acetyl-hexosaminidases that hydrolyze the β-1→4 glycosidic bond of hyaluronan into various oligosaccharide lengths such as tetrasaccharides and hexasaccharides. These enzymes have both hydrolytic and transglycosidase activities, and can degrade hyaluronan and chondroitin sulfates (CS), generally C4-S and C6-S. Hyaluronidases of this type include, but are not limited to, hyaluronidases from cows (bovine) (SEQ ID NOS:10, 11 and 64 and BH55 (U.S. Pat. Nos. 5,747,027 and 5,827,721), nucleic acid molecules set forth in SEQ ID NOS:190-192), sheep (*Ovis aries*) (SEQ ID NO: 26, 27, 63 and 65), nucleic acid molecules set forth in SEQ ID NOS:66 and 193-194), yellow jacket wasp (SEQ ID NOS:12 and 13), honey bee (SEQ ID NO:14), white-face hornet (SEQ ID NO:15), paper wasp (SEQ ID NO:16), mouse (SEQ ID NOS:17-19, 32), pig (SEQ ID NOS:20-21), rat (SEQ ID NOS:22-24, 31), rabbit (SEQ ID NO:25), orangutan (SEQ ID NO:28), cynomolgus monkey (SEQ ID NO:29), guinea pig (SEQ ID NO:30), chimpanzee (SEQ ID NO:101), rhesus monkey (SEQ ID NO:102), and human hyaluronidases (SEQ ID NOS:1-2, 36-39). Exemplary of hyaluronidases in the compositions, combinations and methods provided herein are soluble hyaluronidases.

Mammalian hyaluronidases can be further subdivided into those that are neutral active, predominantly found in testes extracts, and acid active, predominantly found in organs such as the liver. Exemplary neutral active hyaluronidases include PH20, including but not limited to, PH20 derived from different species such as ovine (SEQ ID NOS:27, 63 and 65), bovine (SEQ ID NO:11 and 64) and human (SEQ ID NO:1). Human PH20 (also known as SPAM1 or sperm surface protein PH20), is generally attached to the plasma membrane via a glycosylphosphatidyl inositol (GPI) anchor. It is naturally involved in sperm-egg adhesion and aids penetration by sperm of the layer of cumulus cells by digesting hyaluronic acid.

Besides human PH20 (also termed SPAM1), five hyaluronidase-like genes have been identified in the human genome, HYAL1, HYAL2, HYAL3, HYAL4 and HYALP1. HYALP1 is a pseudogene, and HYAL3 (SEQ ID NO:38) has not been shown to possess enzyme activity toward any known substrates. HYAL4 (precursor polypeptide set forth in SEQ ID NO:39) is a chondroitinase and exhibits little activity towards hyaluronan. HYAL1 (precursor polypeptide set forth in SEQ ID NO:36) is the prototypical acid-active enzyme and PH20 (precursor polypeptide set forth in SEQ ID NO:1) is the prototypical neutral-active enzyme. Acid-active hyaluronidases, such as HYAL1 and HYAL2 (precursor polypeptide set forth in SEQ ID NO:37) generally lack catalytic activity at neutral pH (i.e. pH 7). For example, HYAL1 has little catalytic activity in vitro over pH 4.5 (Frost et al. (1997) *Anal. Biochem.* 251:263-269). HYAL2 is an acid-active enzyme with a very low specific activity in vitro. The hyaluronidase-like enzymes also can be characterized by those which are generally attached to the plasma membrane via a glycosylphosphatidyl inositol (GPI) anchor such as human HYAL2 and human PH20 (Danilkovitch-Miagkova et al. (2003) *Proc Natl Acad Sci USA* 100(8):4580-5), and those which are generally soluble such as human HYAL1 (Frost et al. (1997) *Biochem Biophys Res Commun.* 236(1):10-5).

(a) PH20

PH20, like other mammalian hyaluronidases, is an endo-β-N-acetyl-hexosaminidase that hydrolyzes the β1→4 glycosidic bond of hyaluronic acid into various oligosaccharide lengths such as tetrasaccharides and hexasaccharides. It has both hydrolytic and transglycosidase activities and can degrade hyaluronic acid and chondroitin sulfates, such as C4-S and C6-S. PH20 is naturally involved in sperm-egg adhesion and aids penetration by sperm of the layer of cumulus cells by digesting hyaluronic acid. PH20 is located on the sperm surface, and in the lysosome-derived acrosome, where it is bound to the inner acrosomal membrane. Plasma membrane PH20 has hyaluronidase activity only at neutral pH, while inner acrosomal membrane PH20 has activity at both neutral and acid pH. In addition to being a hyaluronidase, PH20 is reported to be a receptor for HA-induced cell signaling, and a receptor for the zona pellucida surrounding the oocyte.

Exemplary PH20 proteins include, but are not limited to, human (precursor polypeptide set forth in SEQ ID NO:1, mature polypeptide set forth in SEQ ID NO: 2), chimpanzee (SEQ ID NO:101), Rhesus monkey (SEQ ID NO:102) bovine (SEQ ID NOS: 11 and 64), rabbit (SEQ ID NO: 25), ovine PH20 (SEQ ID NOS: 27, 63 and 65), Cynomolgus monkey (SEQ ID NO: 29), guinea pig (SEQ ID NO: 30), rat (SEQ ID NO: 31) and mouse (SEQ ID NO: 32) PH20 polypeptides.

Bovine PH20 is a 553 amino acid precursor polypeptide (SEQ ID NO:11). Alignment of bovine PH20 with the human PH20 shows only weak homology, with multiple gaps existing from amino acid 470 through to the respective carboxy termini due to the absence of a GPI anchor in the bovine polypeptide (see e.g., Frost G1 (2007) *Expert Opin. Drug. Deliv.* 4: 427-440). In fact, clear GPI anchors are not predicted in many other PH20 species besides humans. Thus, PH20 polypeptides produced from ovine and bovine naturally exist as soluble forms. Though bovine PH20 exists very loosely attached to the plasma membrane, it is not anchored via a phospholipase sensitive anchor (Lalancette et al. (2001) *Biol Reprod.* 65(2):628-36). This unique feature of bovine hyaluronidase has permitted the use of the soluble bovine testes hyaluronidase enzyme as an extract for clinical use (Wydase®, Hyalase®).

The human PH20 mRNA transcript is normally translated to generate a 509 amino acid precursor polypeptide (SEQ ID NO:1) containing a 35 amino acid signal sequence at the N-terminus (amino acid residue positions 1-35) and a 19 amino acid glycosylphosphatidylinositol (GPI) anchor attachment signal sequence at the C-terminus (amino acid residue positions 491-509). The mature PH20 therefore, is a 474 amino acid polypeptide set forth in SEQ ID NO:2. Following transport of the precursor polypeptide to the ER and removal of the signal peptide, the C-terminal GPI-attachment signal peptide is cleaved to facilitate covalent attachment of a GPI anchor to the newly-formed C-terminal amino acid at the amino acid position corresponding to position 490 of the precursor polypeptide set forth in SEQ ID NO:1. Thus, a 474 amino acid GPI-anchored mature polypeptide with an amino acid sequence set forth in SEQ ID NO:2 is produced.

Human PH20 exhibits hyaluronidase activity at neutral and acid pH. In one aspect, human PH20 is the prototypical neutral-active hyaluronidase that is generally locked to the plasma membrane via a GPI anchor. In another aspect, PH20 is expressed on the inner acrosomal membrane where it has hyaluronidase activity at neutral and acid pH. PH20 contains two catalytic sites at distinct regions of the polypeptide: the Peptide 1 and Peptide 3 regions (Cherr et al. (2001) *Matrix Biology* 20:515-525). Evidence indicates that the Peptide 1 region of PH20, which corresponds to amino acid positions 107-137 of the mature polypeptide set forth in SEQ ID NO:2 and positions 142-172 of the precursor polypeptide set forth in SEQ ID NO:1, is required for enzyme activity at neutral pH. Amino acids at positions 111 and 113 (corresponding to the mature PH20 polypeptide set forth in SEQ ID NO:2) within this region are reported to be important for activity, as mutagenesis by amino acid replacement results in PH20 polypeptides with 3% hyaluronidase activity or undetectable hyaluronidase activity, respectively, compared to the wild-type PH20 (Arming et al., (1997) *Eur. J. Biochem.* 247:810-814).

The Peptide 3 region, which corresponds to amino acid positions 242-262 of the mature polypeptide set forth in SEQ ID NO:2, and positions 277-297 of the precursor polypeptide set forth in SEQ ID NO: 1, is reported to be important for enzyme activity at acidic pH. Within this region, amino acids at positions 249 and 252 of the mature PH20 polypeptide are reported to be essential for activity as mutagenesis of either results in a polypeptide essentially devoid of activity (Arming et al., (1997) *Eur. J. Biochem.* 247:810-814).

In addition to the catalytic sites, PH20 also contains a hyaluronan-binding site. Experimental evidence indicate that this site is located in the Peptide 2 region, which corresponds to amino acid positions 205-235 of the precursor polypeptide set forth in SEQ ID NO: 1 and positions 170-200 of the mature polypeptide set forth in SEQ ID NO:2. This region is highly conserved among hyaluronidases and is similar to the heparin binding motif. Mutation of the arginine residue at position 176 (corresponding to the mature PH20 polypeptide set forth in SEQ ID NO:2) to a glycine results in a polypeptide with only about 1% of the hyaluronidase activity of the wild type polypeptide (Arming et al., (1997) *Eur. J. Biochem.* 247:810-814).

There are seven potential glycosylation sites, including N-linked glycosylation sites, in human PH20 at N82, N166, N235, N254, N368, N393, S490 of the polypeptide exemplified in SEQ ID NO: 1. Because amino acids 36 to 464 of SEQ ID NO:1 is reported to contain the minimally active human PH20 hyaluronidase domain, the glycosylation site S-490 is not required for proper hyaluronidase activity. There are six disulfide bonds in human PH20. Two disulfide bonds between the cysteine residues C60 and C351 and between C224 and C238 of the polypeptide exemplified in SEQ ID NO: 1 (corresponding to residues C25 and C316, and C189 and C203 of the mature polypeptide set forth in SEQ ID NO:2, respectively). A further four disulfide bonds are formed between the cysteine residues C376 and C387; between C381 and C435; between C437 and C443; and between C458 and C464 of the polypeptide exemplified in SEQ ID NO: 1 (corresponding to residues C341 and C352; between C346 and C400; between C402 and C408; and between C423 and C429 of the mature polypeptide set forth in SEQ ID NO:2, respectively).

(2) Other Hyaluronidases

Bacterial hyaluronidases (EC 4.2.2.1 or EC 4.2.99.1) degrade hyaluronan and, to various extents, chondroitin sulfates and dermatan sulfates. Hyaluronan lyases isolated from bacteria differ from hyaluronidases (from other sources, e.g., hyaluronoglucosaminidases, EC 3.2.1.35) by their mode of action. They are endo-β-N-acetylhexosaminidases that catalyze an elimination reaction, rather than hydrolysis, of the β1→4-glycosidic linkage between N-acetyl-beta-D-glucosamine and D-glucuronic acid residues in hyaluronan, yielding 3-(4-deoxy-β-D-gluc-4-enuronosyl)-N-acetyl-D-glucosamine tetra- and hexasaccharides, and disaccharide end products. The reaction results in the formation of oligosaccharides with unsaturated hexuronic acid residues at their nonreducing ends.

Exemplary hyaluronidases from bacteria for use in the compositions, combinations and methods provided include, but are not limited to, hyaluronan degrading enzymes in microorganisms, including strains of *Arthrobacter, Bdellovibrio, Clostridium, Micrococcus, Streptococcus, Peptococcus, Propionibacterium, Bacteroides,* and *Streptomyces*. Particular examples of such strains and enzymes include, but are not limited to *Arthrobacter* sp. (strain FB24 (SEQ ID NO:67)), *Bdellovibrio bacteriovorus* (SEQ ID NO:68), *Propionibacterium acnes* (SEQ ID NO:69), *Streptococcus agalactiae* ((SEQ ID NO:70); 18RS21 (SEQ ID NO:71); serotype Ia (SEQ ID NO:72); serotype III (SEQ ID NO:73)), *Staphylococcus aureus* (strain COL (SEQ ID NO:74); strain MRSA252 (SEQ ID NOS:75 and 76); strain MSSA476 (SEQ ID NO:77); strain NCTC 8325 (SEQ ID NO:78); strain bovine RF122 (SEQ ID NOS:79 and 80); strain USA300 (SEQ ID NO:81)), *Streptococcus pneumoniae* ((SEQ ID NO:82); strain ATCC BAA-255/R6 (SEQ ID NO:83); serotype 2, strain D39/NCTC 7466 (SEQ ID NO:84)), *Streptococcus pyogenes* (serotype M1 (SEQ ID NO:85); serotype M2, strain MGAS10270 (SEQ ID NO:86); serotype M4, strain MGAS10750 (SEQ ID NO:87); serotype M6 (SEQ ID NO:88); serotype M12, strain MGAS2096 (SEQ ID NOS:89 and 90); serotype M12, strain MGAS9429 (SEQ ID NO:91); serotype M28 (SEQ ID NO:92)), *Streptococcus suis* (SEQ ID NOS:93-95); *Vibrio fischeri* (strain ATCC 700601/ES114 (SEQ ID NO:96)), and the *Streptomyces hyaluronolyticus* hyaluronidase enzyme, which is specific for hyaluronic acid and does not cleave chondroitin or chondroitin sulfate (Ohya, T. and Kaneko, Y. (1970) *Biochim. Biophys. Acta* 198:607). Hyaluronidases from leeches, other parasites, and crustaceans (EC 3.2.1.36) are endo-β-glucuronidases that generate tetra- and hexasaccharide end-products. These enzymes catalyze hydrolysis of 1→6-linkages between β-D-glucuronate and N-acetyl-D-glucosamine residues in hyaluronate. Exemplary hyaluronidases from leeches include, but are not limited to, hyaluronidase from Hirudimidae (e.g., *Hirudo medicinalis*), Erpobdellidae (e.g., *Nephelopsis obscura* and *Erpobdella punctata*), Glossiphoniidae (e.g., *Desserobdella picta, Helobdella stagnalis, Glossiphonia complanata, Placobdella ornata* and *Theromyzon* sp.) and Haemopidae (*Haemopis marmorata*) (Hovingh et al. (1999) *Comp Biochem Physiol B Biochem Mol. Biol.* 124(3):319-26). An exemplary hyaluronidase from bacteria that has the same mechanism of action as the leech hyaluronidase is that from the cyanobacteria, *Synechococcus* sp. (strain RCC307, SEQ ID NO:97).

(3) Other Hyaluronan Degrading Enzymes

In addition to the hyaluronidase family, other hyaluronan degrading enzymes can be used in the compositions, combinations and methods provided. For example, enzymes, including particular chondroitinases and lyases, that have the ability to cleave hyaluronan can be employed. Exemplary chondroitinases that can degrade hyaluronan include, but are not limited to, chondroitin ABC lyase (also known as chondroitinase ABC), chondroitin AC lyase (also known as chondroitin sulfate lyase or chondroitin sulfate eliminase) and chondroitin C lyase. Methods for production and purification of such enzymes for use in the compositions, combinations, and methods provided are known in the art (e.g., U.S. Pat. No. 6,054,569; Yamagata, et al. (1968) *J. Biol. Chem.* 243(7): 1523-1535; Yang et al. (1985) *J. Biol. Chem.* 160(30):1849-1857).

Chondroitin ABC lyase contains two enzymes, chondroitin-sulfate-ABC endolyase (EC 4.2.2.20) and chondroitin-sulfate-ABC exolyase (EC 4.2.2.21) (Hamai et al. (1997) *J Biol Chem.* 272(14):9123-30), which degrade a variety of glycosaminoglycans of the chondroitin-sulfate- and dermatan-sulfate type. Chondroitin sulfate, chondroitin-sulfate proteoglycan and dermatan sulfate are the preferred substrates for chondroitin-sulfate-ABC endolyase, but the enzyme also can act on hyaluronan at a lower rate. Chondroitin-sulfate-ABC endolyase degrades a variety of glycosaminoglycans of the chondroitin-sulfate- and dermatan-sulfate type, producing a mixture of Δ4-unsaturated oligosaccharides of different sizes that are ultimately degraded to Δ4-unsaturated tetra- and disaccharides. Chondroitin-sulfate-ABC exolyase has the same substrate specificity but removes disaccharide residues from the non-reducing ends of both polymeric chondroitin sulfates and their oligosaccharide fragments produced by chondroitin-sulfate-ABC endolyase (Hamai, A. et al. (1997) *J. Biol. Chem.* 272: 9123-9130). Exemplary chondroitin-sulfate-ABC endolyases and chondroitin-sulfate-ABC exolyases include, but are not limited to, those from *Proteus vulgaris* and *Pedobacter heparinus* (the *Proteus vulgaris* chondroitin-sulfate-ABC endolyase is set forth in SEQ ID NO: 98 (Sato et al. (1994) *Appl. Microbiol. Biotechnol.* 41(1):39-46).

Chondroitin AC lyase (EC 4.2.2.5) is active on chondroitin sulfates A and C, chondroitin and hyaluronic acid, but is not active on dermatan sulfate (chondroitin sulfate B). Exemplary chondroitinase AC enzymes from the bacteria include, but are not limited to, those from *Pedobacter heparinus* and *Victivallis vadensis*, set forth in SEQ ID NOS:99 and 100, respectively, and *Arthrobacter aurescens* (Tkalec et al. (2000) *Applied and Environmental Microbiology* 66(1):29-35; Ernst et al. (1995) *Critical Reviews in Biochemistry and Molecular Biology* 30(5):387-444).

Chondroitinase C cleaves chondroitin sulfate C producing tetrasaccharide plus an unsaturated 6-sulfated disaccharide (delta Di-6S). It also cleaves hyaluronic acid producing unsaturated non-sulfated disaccharide (delta Di-OS). Exemplary chondroitinase C enzymes from the bacteria include, but are not limited to, those from *Streptococcus* and *Flavobacterium* (Hibi et al. (1989) *FEMS-Microbiol-Lett.* 48(2): 121-4; Michelacci et al. (1976) *J. Biol. Chem.* 251:1154-8; Tsuda et al. (1999) *Eur. J. Biochem.* 262:127-133).

ii. Soluble Hyaluronan Degrading Enzymes

Provided in the compositions, combinations, uses and methods herein are soluble hyaluronan degrading enzymes, including soluble hyaluronidases. Soluble hyaluronan degrading enzymes include any hyaluronan degrading enzymes that are secreted from cells (e.g. CHO cell) upon expression and exist in soluble form. Such enzymes include, but are not limited to, soluble hyaluronidases, including non-human soluble hyaluronidases, including non-human animal soluble hyaluronidases, bacterial soluble hyaluronidases and human hyaluronidases, Hyal1, bovine PH20 and ovine PH20, allelic variants thereof and other variants thereof. For example, included among soluble hyaluronan degrading enzymes are any hyaluronan degrading enzymes that have been modified to be soluble. For example, hyaluronan degrading enzymes that contain a GPI anchor can be made soluble by truncation of and removal of all or a portion of the GPI anchor. In one example, the human hyaluronidase PH20, which is normally membrane anchored via a GPI anchor, can be made soluble by truncation of and removal of all or a portion of the GPI anchor at the C-terminus.

Soluble hyaluronan degrading enzymes also include neutral active and acid active hyaluronidases. Depending on factors, such as, but not limited to, the desired level of activity of the enzyme following administration and/or site of administration, neutral active and acid active hyaluronidases can be selected. In a particular example, the hyaluronan degrading enzyme for use in the compositions, combinations and methods herein is a soluble neutral active hyaluronidase.

Exemplary of a soluble hyaluronidase is PH20 from any species, such as any set forth in any of SEQ ID NOS: 1, 2, 11, 25, 27, 29-32, 63-65 and 101-102, or truncated forms thereof lacking all or a portion of the C-terminal GPI anchor, so long as the hyaluronidase is soluble (secreted upon expression) and retains hyaluronidase activity. Also included among soluble hyaluronidases are allelic variants or other variants of any of SEQ ID NOS:1, 2, 11, 25, 27, 29-32, 63-65 and 101-102, or truncated forms thereof. Allelic variants and other variants are known to one of skill in the art, and include polypeptides having 60%, 70%, 80%, 90%, 91%, 92%, 93%, 94%, 95%, 96%., 97%, 98%, 99% or more sequence identity to any of SEQ ID NOS: 1, 2, 11, 25, 27, 29-32, 63-65 and 101-102, or truncated forms thereof. Amino acid variants include conservative and non-conservative mutations. It is understood that residues that are important or otherwise required for the activity of a hyaluronidase, such as any described above or known to skill in the art, are generally invariant and cannot be changed. These include, for example, active site residues. Thus, for example, amino acid residues 111, 113 and 176 (corresponding to residues in the mature PH20 polypeptide set forth in SEQ ID NO:2) of a human PH20 polypeptide, or soluble form thereof, are generally invariant and are not altered. Other residues that confer glycosylation and formation of disulfide bonds required for proper folding also can be invariant.

In some instances, the soluble hyaluronan degrading enzyme is normally GPI-anchored (such as, for example, human PH20) and is rendered soluble by truncation at the C-terminus. Such truncation can remove all of the GPI anchor attachment signal sequence; or can remove only some of the GPI anchor attachment signal sequence. The resulting polypeptide, however, is soluble. In instances where the soluble hyaluronan degrading enzyme retains a portion of the GPI anchor attachment signal sequence, 1, 2, 3, 4, 5, 6, 7 or more amino acid residues in the GPI-anchor attachment signal sequence can be retained, provided the polypeptide is soluble. Polypeptides containing one or more amino acids of the GPI anchor are termed extended soluble hyaluronan degrading enzymes. One of skill in the art can determine whether a polypeptide is GPI-anchored using methods well known in the art. Such methods include, but are not limited to, using known algorithms to predict the presence and location of the GPI-anchor attachment signal sequence and ω-site, and performing solubility analyses before and after digestion with phosphatidylinositol-specific phospholipase C (PI-PLC) or D (PI-PLD).

Extended soluble hyaluronan degrading enzymes can be produced by making C-terminal truncations to any naturally GPI-anchored hyaluronan degrading enzyme such that the resulting polypeptide is soluble and contains one or more amino acid residues from the GPI-anchor attachment signal sequence (see, e.g., U.S. Published Pat. Appl. No. US20100143457). Exemplary extended soluble hyaluronan degrading enzymes that are C-terminally truncated but retain a portion of the GPI anchor attachment signal sequence include, but are not limited to, extended soluble PH20 (esPH20) polypeptides of primate origin, such as, for example, human and chimpanzee esPH20 polypeptides. For example, the esPH20 polypeptides can be made by C-terminal truncation of any of the mature or precursor polypeptides set forth in SEQ ID NOS:1, 2 or 101, or allelic or other variation thereof, including active fragment thereof, wherein the resulting polypeptide is soluble and retains one or more amino acid residues from the GPI-anchor attachment signal sequence. Allelic variants and other variants are known to one of skill in the art, and include polypeptides having 60%, 70%, 80%, 90%, 91%, 92%, 93%, 94%, 95% or more sequence identity to any of SEQ ID NOS: 1 or 2. The esPH20 polypeptides provided herein can be C-terminally truncated by 1, 2, 3, 4, 5, 6, 7, 8, 9, 10 or more amino acids compared to the wild type polypeptide, such as a polypeptide with a sequence set forth in SEQ ID NOS: 1, 2 or 101, provided the resulting esPH20 polypeptide is soluble and retains 1 or more amino acid residues from the GPI-anchor attachment signal sequence.

Typically, for use in the compositions, combinations and methods herein, a soluble human hylauronan degrading enzyme, such as a soluble human PH20, is used. Although hylauronan degrading enzymes, such as PH20, from other animals can be utilized, such preparations are potentially immunogenic, since they are animal proteins. For example, a significant proportion of patients demonstrate prior sensitization secondary to ingested foods, and since these are animal proteins, all patients have a risk of subsequent sensitization. Thus, non-human preparations may not be suitable for chronic use. If non-human preparations are desired, it is contemplated herein that such polypeptides can be prepared to have reduced immunogenicity. Such modifications are within the level of one of skill in the art and can include, for example, removal and/or replacement of one or more antigenic epitopes on the molecule.

Hyaluronan degrading enzymes, including hyaluronidases (e.g., PH20), used in the methods herein can be recombinantly produced or can be purified or partially-purified from natural sources, such as, for example, from testes extracts. Methods for production of recombinant proteins, including recombinant hyaluronan degrading enzymes, are provided elsewhere herein and are well known in the art.

(1) Soluble Human PH20

Exemplary of a soluble hyaluronidase is soluble human PH20, Soluble forms of recombinant human PH20 have been produced and can be used in the compositions, combinations and methods described herein. The production of such soluble forms of PH20 is described in U.S. Published Patent Application Nos. US20040268425; US20050260186, US20060104968, US20100143457 and International PCT application No. WO2009111066. For example, soluble PH20 polypeptides, include C-terminally truncated variant polypeptides that include a sequence of amino acids in SEQ ID NO:1, or have at least 91%, 92%, 93%, 94%, 95%, 95%, 97%, 98% sequence identity to a sequence of amino acids included in SEQ ID NO:1, retain hyaluronidase activity and are soluble. Included among these polypeptides are soluble PH20 polypeptides that completely lack all or a portion of the GPI-anchor attachment signal sequence.

Also included are extended soluble PH20 (esPH20) polypeptides that contain at least one amino acid of the GPI anchor. Thus, instead of having a GPI-anchor covalently attached to the C-terminus of the protein in the ER and being anchored to the extracellular leaflet of the plasma membrane, these polypeptides are secreted and are soluble. C-terminally truncated PH20 polypeptides can be C-terminally truncated by 1, 2, 3, 4, 5, 6, 7, 8, 9, 10, 11, 12, 13, 14, 15, 16, 17, 18, 19, 20, 25, 30, 35, 40, 45, 50, 55, 60 or more amino acids compared to the full length wild type polypeptide, such as a full length wild type polypeptide with a sequence set forth in SEQ ID NOS:1 or 2, or allelic or species variants or other variants thereof.

For example, soluble forms include, but are not limited to, C-terminal truncated polypeptides of human PH20 set forth in SEQ ID NO:1 having a C-terminal amino acid residue 467, 468, 469, 470, 471, 472, 473, 474, 475, 476, 477, 478, 479, 480, 481, 482 and 483, 484, 485, 486, 487, 488, 489, 490, 491, 492, 493, 494, 495, 496, 497, 498, 499 or 500 of the sequence of amino acids set forth in SEQ ID NO:1, or polypeptides that exhibit at least 85% identity thereto. Soluble forms of human PH20 generally include those that contain amino acids 36-464 set forth in SEQ ID NO:1. For example, when expressed in mammalian cells, the 35 amino acid N-terminal signal sequence is cleaved during processing, and the mature form of the protein is secreted. Thus, the mature soluble polypeptides contain amino acids 36 to 467, 468, 469, 470, 471, 472, 473, 474, 475, 476, 477, 478, 479, 480, 481, 482 and 483 of SEQ ID NO:1. Table 3 provides non-limiting examples of exemplary C-terminally truncated PH20 polypeptides, including C-terminally truncated soluble PH20 polypeptides.

In Table 3 below, the length (in amino acids) of the precursor and mature polypeptides, and the sequence identifier (SEQ ID NO) in which exemplary amino acid sequences of the precursor and mature polypeptides of the C-terminally truncated PH20 proteins are set forth, are provided. The wild-type PH20 polypeptide also is included in Table 3 for comparison. In particular, exemplary of soluble hyaluronidases are soluble human PH20 polypeptides that are 442, 443, 444, 445, 446 or 447 amino acids in length, such as set forth in any of SEQ ID NOS: 4-9, or allelic or species variants or other variants thereof.

TABLE 3

Exemplary C-terminally truncated PH20 polypeptides

| Polypeptide | Precursor (amino acids) | Precursor SEQ ID NO | Mature (amino acids) | Mature SEQ ID NO |
|---|---|---|---|---|
| wildtype | 509 | 1 | 474 | 2 |
| SPAM1-SILF | 500 | 139 | 465 | 183 |
| SPAM-VSIL | 499 | 106 | 464 | 150 |
| SPAM1-IVSI | 498 | 140 | 463 | 184 |
| SPAM1-FIVS | 497 | 107 | 462 | 151 |
| SPAM1-MFIV | 496 | 141 | 461 | 185 |
| SPAM1-TMFI | 495 | 108 | 460 | 152 |
| SPAM1-ATMF | 494 | 142 | 459 | 186 |
| SPAM1-SATM | 493 | 109 | 458 | 153 |
| SPAM1-LSAT | 492 | 143 | 457 | 187 |
| SPAM1-TLSA | 491 | 110 | 456 | 154 |
| SPAM1-STLS | 490 | 112 | 455 | 156 |
| SPAM1-PSTL | 489 | 111 | 454 | 155 |
| SPAM1-SPST | 488 | 144 | 453 | 188 |
| SPAM1-ASPS | 487 | 113 | 452 | 157 |
| SPAM1-NASP | 486 | 145 | 451 | 189 |
| SPAM1-YNAS | 485 | 114 | 450 | 158 |
| SPAM1-FYNA | 484 | 115 | 449 | 159 |
| SPAM1-IFYN | 483 | 46 | 448 | 48 |
| SPAM1-QIFY | 482 | 3 | 447 | 4 |
| SPAM1-PQIF | 481 | 45 | 446 | 5 |
| SPAM1-EPQI | 480 | 44 | 445 | 6 |
| SPAM1-EEPQ | 479 | 43 | 444 | 7 |
| SPAM1-TEEP | 478 | 42 | 443 | 8 |
| SPAM1-ETEE | 477 | 41 | 442 | 9 |
| SPAM1-METE | 476 | 116 | 441 | 160 |
| SPAM1-PMET | 475 | 117 | 440 | 161 |
| SPAM1-PPME | 474 | 118 | 439 | 162 |
| SPAM1-KPPM | 473 | 119 | 438 | 163 |
| SPAM1-LKPP | 472 | 120 | 437 | 164 |
| SPAM1-FLKP | 471 | 121 | 436 | 165 |
| SPAM1-AFLK | 470 | 122 | 435 | 166 |
| SPAM1-DAFL | 469 | 123 | 434 | 167 |
| SPAM1-IDAF | 468 | 124 | 433 | 168 |
| SPAM1-CIDA | 467 | 40 | 432 | 47 |
| SPAM1-VCID | 466 | 125 | 431 | 169 |
| SPAM1-GVCI | 465 | 126 | 430 | 170 |

For example, exemplary C-terminally truncated PH20 polypeptides that exhibit hyaluronidase activity, are secreted from cells and are soluble include any of the mature forms of a truncated human PH20 set forth in Table 3, or variants thereof that exhibit hyaluronidase activity. For example, the PH20 or truncated form thereof contains the sequence of amino acids set forth in any of SEQ ID NOS: 4-9, 47, 48, 150-170 and 183-189 or a sequence of amino acids that exhibits at least 85% sequence identity to any of SEQ ID NOS: 4-9, 47, 48, 150-170 and 183-189. For example, the PH20 polypeptide can exhibit at least 85%, 87%, 88%, 89%, 90%, 91%, 92%, 93%, 94%, 95%, 96%, 97%, 98%, 99% or more sequence identity to any of SEQ ID NOS: 4-9, 47, 48, 150-170 and 183-189.

Generally soluble forms of PH20 are produced using protein expression systems that facilitate correct N-glycosylation to ensure the polypeptide retains activity, since glycosylation is important for the catalytic activity and stability of hyaluronidases. Such cells include, for example Chinese Hamster Ovary (CHO) cells (e.g. DG44 CHO cells).

(2) rHuPH20

Recombinant soluble forms of human PH20 have been generated and can be used in the compositions, combinations and methods provided herein. The generation of such soluble forms of recombinant human PH20 are described, for example, in U.S. Published Patent Application Nos. US20040268425; US 20050260186; US20060104968; US20100143457; and International PCT Appl. No. WO2009111066. Exemplary of such polypeptides are those generated by expression of a nucleic acid molecule encoding amino acids 1-482 (set forth in SEQ ID NO:3). Such an exemplary nucleic acid molecule is set forth in SEQ ID NO:49. Post translational processing removes the 35 amino acid signal sequence, leaving a 447 amino acid soluble recombinant human PH20 (SEQ ID NO:4). As produced in the culture medium there is heterogeneity at the C-terminus such that the product, designated rHuPH20, includes a mixture of species that can include any one or more of SEQ ID NOS. 4-9 in various abundance. Typically, rHuPH20 is produced in cells that facilitate correct N-glycosylation to retain activity, such as CHO cells (e.g. DG44 CHO cells).

iii. Glycosylation of Hyaluronan Degrading Enzymes

Glycosylation, including N- and O-linked glycosylation, of some hyaluronan degrading enzymes, including hyaluronidases, can be important for their catalytic activity and stability. While altering the type of glycan modifying a glycoprotein can have dramatic affects on a protein's antigenicity, structural folding, solubility, and stability, most enzymes are not thought to require glycosylation for optimal enzyme activity. For some hyaluronidases, removal of N-linked glycosylation can result in near complete inactivation of the hyaluronidase activity. Thus, for such hyaluronidases, the presence of N-linked glycans is critical for generating an active enzyme.

N-linked oligosaccharides fall into several major types (oligomannose, complex, hybrid, sulfated), all of which have (Man) 3-GlcNAc-GlcNAc- cores attached via the amide nitrogen of Asn residues that fall within -Asn-Xaa-Thr/Ser- sequences (where Xaa is not Pro). Glycosylation at an -Asn-Xaa-Cys-site has been reported for coagulation protein C. In some instances, a hyaluronan degrading enzyme, such as a hyaluronidase, can contain both N-glycosidic and O-glycosidic linkages. For example, PH20 has O-linked oligosaccharides as well as N-linked oligosaccharides. There are seven potential glycosylation sites at N82, N166, N235, N254, N368, N393, S490 of human PH20 exemplified in SEQ ID NO: 1. Amino acid residues N82, N166 and N254 are occupied by complex type glycans whereas amino acid residues N368 and N393 are occupied by high mannose type glycans. Amino acid residue N235 is occupied by approximately 80% high mannose type glycans and 20% complex type glycans. As noted above, O-linked glycosylation at S490 is not required for hyaluronidase activity.

In some examples, the hyaluronan degrading enzymes for use in the compositions, combinations and/or methods provided are glycosylated at one or all of the glycosylation sites. For example, for human PH20, or a soluble form thereof, 2, 3, 4, 5, or 6 of the N-glycosylation sites corresponding to amino acids N82, N166, N235, N254, N368, and N393 of SEQ ID NO: 1 are glycosylated. In some examples the hyaluronan degrading enzymes are glycosylated at one or more native glycosylation sites. In other examples, the hyaluronan degrading enzymes are modified at one or more non-native glycosylation sites to confer glycosylation of the polypeptide at one or more additional site. In such examples, attachment of additional sugar moieties can enhance the pharmacokinetic properties of the molecule, such as improved half-life and/or improved activity.

In other examples, the hyaluronan degrading enzymes for use in the compositions, combinations and/or methods provided herein are partially deglycosylated (or N-partially glycosylated polypeptides). For example, partially deglycosylated soluble PH20 polypeptides that retain all or a portion of the hyaluronidase activity of a fully glycosylated hyaluronidase can be used in the compositions, combinations and/or methods provided herein. Exemplary partially deglycosylated hyalurodinases include soluble forms of a partially deglycosylated PH20 polypeptides from any species, such as any set forth in any of SEQ ID NOS: 1, 2, 11, 25, 27, 29-32, 63, 65, and 101-102, or allelic variants, truncated variants, or other variants thereof. Such variants are known to one of skill in the art, and include polypeptides having 60%, 70%, 80%, 90%, 91%, 92%, 93%, 94%, 95% or more sequence identity to any of SEQ ID NOS: 1, 2, 11, 25, 27, 29-32, 63, 65, and 101-102, or truncated forms thereof. The partially deglycosylated hyaluronidases provided herein also include hybrid, fusion and chimeric partially deglycosylated hyaluronidases, and partially deglycosylated hyaluronidase conjugates.

Glycosidases, or glycoside hydrolases, are enzymes that catalyze the hydrolysis of the glycosidic linkage to generate two smaller sugars. The major types of N-glycans in vertebrates include high mannose glycans, hybrid glycans and complex glycans. There are several glycosidases that result in only partial protein deglycosylation, including: EndoF1, which cleaves high mannose and hybrid type glycans; EndoF2, which cleaves biantennary complex type glycans; EndoF3, which cleaves biantennary and more branched complex glycans; and EndoH, which cleaves high mannose and hybrid type glycans. Treatment of a hyaluronan degrading enzyme, such as a soluble hyaluronidase, such as a soluble PH20, with one or all of these glycosidases can result in only partial deglycosylation and, therefore, retention of hyaluronidase activity.

Partially deglycosylated hyaluronan degrading enzymes, such as partially deglycosylated soluble hyaluronidases, can be produced by digestion with one or more glycosidases, generally a glycosidase that does not remove all N-glycans but only partially deglycosylates the protein. For example, treatment of PH20 (e.g. a recombinant PH20 designated rHuPH20) with one or all of the above glycosidases (e.g. EndoF1, EndoF2 and/or EndoF3) results in partial deglycosylation. These partially deglycosylated PH20 polypeptides can exhibit hyaluronidase enzymatic activity that is comparable to the fully glycosylated polypeptides. In contrast, treatment of PH20 with PNGaseF, a glycosidase that cleaves all N-glycans, results in complete removal of all N-glycans and thereby renders PH20 enzymatically inactive. Thus, although all N-linked glycosylation sites (such as, for example, those at amino acids N82, N166, N235, N254, N368, and N393 of human PH20, exemplified in SEQ ID NO: 1) can be glycosylated, treatment with one or more glycosidases can render the extent of glycosylation reduced compared to a hyaluronidase that is not digested with one or more glycosidases.

The partially deglycosylated hyaluronan degrading enzymes, including partially deglycosylated soluble PH20 polypeptides, can have 10%, 20%, 30%, 40%, 50%, 60%, 70% or 80% of the level of glycosylation of a fully glycosylated polypeptide. In one example, 1, 2, 3, 4, 5 or 6 of the N-glycosylation sites corresponding to amino acids N82, N166, N235, N254, N368, and N393 of SEQ ID NO:1 are partially deglycosylated, such that they no longer contain high mannose or complex type glycans, but rather contain at least an N-acetylglucosamine moiety. In some examples, 1, 2 or 3 of the N-glycosylation sites corresponding to amino acids N82, N166 and N254 of SEQ ID NO:1 are deglycosylated, that is, they do not contain a sugar moiety. In other examples, 3, 4, 5, or 6 of the N-glycosylation sites corresponding to amino acids N82, N166, N235, N254, N368, and N393 of SEQ ID NO:1 are glycosylated. Glycosylated amino acid residues minimally contain an N-acetylglucosamine moiety. Typically, the partially deglyclosylated hyaluronan degrading enzymes, including partially deglycosylated soluble PH20 polypeptides, exhibit hyaluronidase activity that is 10%, 20%, 30%, 40%, 50%, 60%, 70%, 80%, 90%, 100%, 110%, 120%, 130%, 140%, 150%, 200%, 300%, 400%, 500%, 1000% or more of the hyaluronidase activity exhibited by the fully glycosylated polypeptide.

iv. Modified (Polymer-Conjugated) Hyaluronan Degrading Enzymes

In one example, the provided compositions and combinations contain hyaluronan degrading enzymes, in particular soluble hyaluronidases, that have been modified by conjugation to one or more polymeric molecule (polymer), typically to increase the half-life of the hyaluronan degrading enzyme, for example, to promote prolonged/sustained treatment effects in a subject.

Covalent or other stable attachment (conjugation) of polymeric molecules, such as polyethylene glycol (PEGylation moiety (PEG)), to the hyaluronan degrading enzymes, such as hyaluronidases, impart beneficial properties to the resulting hyaluronan degrading enzyme-polymer composition. Such properties include improved biocompatibility, extension of protein (and enzymatic activity) half-life in the blood, cells and/or in other tissues within a subject, effective shielding of the protein from proteases and hydrolysis, improved biodistribution, enhanced pharmacokinetics and/or pharmacodynamics, and increased water solubility.

Hence, in particular examples herein, the hyaluronan degrading enzyme is conjugated to a polymer. Exemplary of polymers are such as polyols (i.e. poly-OH), polyamines (i.e. poly-NH$_2$) and polycarboxyl acids (i.e. poly-COOH), and further heteropolymers i.e. polymers comprising one or more different coupling groups e.g. a hydroxyl group and amine groups. Examples of suitable polymeric molecules include polymeric molecules selected from among polyalkylene oxides (PAO), such as polyalkylene glycols (PAG), including polyethylene glycols (PEG), methoxypolyethylene glycols (mPEG) and polypropylene glycols, PEG-glycidyl ethers (Epox-PEG), PEG-oxycarbonylimidazole (CDI-PEG) branched polyethylene glycols (PEGs), polyvinyl alcohol (PVA), polycarboxylates, polyvinylpyrrolidone, poly-D,L-amino acids, polyethylene-co-maleic acid anhydride, polystyrene-co-maleic acid anhydride, dextrans including carboxymethyl-dextrans, heparin, homologous albumin, celluloses, including methylcellulose, carboxymethylcellulose, ethylcellulose, hydroxyethylcellulose carboxyethylcellulose and hydroxypropylcellulose, hydrolysates of chitosan, starches such as hydroxyethyl-starches and hydroxypropyl-starches, glycogen, agaroses and derivatives thereof, guar gum, pullulan, inulin, xanthan gum, carrageenan, pectin, alginic acid hydrolysates and bio-polymers.

In particular, the polymer is a polyethylene glycol (PEG). Suitable polymeric molecules for attachment to the hyaluronan degrading enzymes, including hyaluronidases, include, but are not limited to, polyethylene glycol (PEG) and PEG derivatives such as methoxy-polyethylene glycols (mPEG), PEG-glycidyl ethers (Epox-PEG), PEG-oxycarbonylimidazole (CDI-PEG), branched PEGs, and polyethylene oxide (PEO) (see e.g. Roberts et al., *Advanced Drug Delivery Review* (2002) 54: 459-476; Harris and Zalipsky, S (eds.) "Poly(ethylene glycol), Chemistry and Biological Applications" ACS Symposium Series 680, 1997; Mehvar et al., *J. Pharm. Pharmaceut. Sci.,* 3(1):125-136, 2000; Harris, (2003) *Nature Reviews Drug Discovery* 2:214-221; and Tsubery, (2004) *J. Biol. Chem.* 279(37):38118-24). The polymeric molecule can be of a molecular weight typically ranging from about 3 kDa to about 60 kDa. In some embodiments the polymeric molecule that is conjugated to a protein, such as rHuPH20, has a molecular weight of 5, 10, 15, 20, 25, 30, 35, 40, 45, 50, 55, 60 or more than 60 kDa.

Various methods of modifying polypeptides by covalently attaching (conjugating) a PEG or PEG derivative (i.e. "PEGylation") are known in the art (see e.g., U.S. 2006/0104968; U.S. Pat. No. 5,672,662; U.S. Pat. No. 6,737,505; and U.S. 2004/0235734). Such techniques are described elsewhere herein.

2. Pharmaceutical Compositions and Formulations

Provided herein are pharmaceutical compositions of anti-hyaluronan agents, for example, a hyaluronan-degrading enzyme or modified form thereof (e.g. a PEGylated hyaluronan-degrading enzymes, such as PEGylated hyaluronidases), for use in the treatment methods provided. Also provided herein are pharmaceutical compositions containing a second agent that is used to treat a disease or disorder associated with a hyaluronan-associated disease or condition, such as cancer. Exemplary of such agents include, but are not limited to, anti-cancer agents including drugs, polypeptides, nucleic acids, antibodies, peptides, small molecules, gene therapy vector, viruses and other therapeutics. Anti-hyaluronan agents, for example, a hyaluronan-degrading enzyme or modified form thereof (e.g. a PEGylated hyaluronan-degrading enzymes, such as PEGylated hyaluronidases or PEGPH20), can be co-formulated or co-administered with pharmaceutical formulations of such second agents to enhance their delivery to desired sites or tissues within the body associated with excess or accumulated hyaluronan.

Pharmaceutically acceptable compositions are prepared in view of approvals for a regulatory agency or other agency prepared in accordance with generally recognized pharmacopeia for use in animals and in humans. The compounds can be formulated into any suitable pharmaceutical preparations for any of oral and intravenous administration such as solutions, suspensions, powders, or sustained release formulations. Typically, the compounds are formulated into pharmaceutical compositions using techniques and procedures well known in the art (see e.g., Ansel *Introduction to Pharmaceutical Dosage Forms*, Fourth Edition, 1985, 126). The formulation should suit the mode of administration.

In one example, pharmaceutical preparation can be in liquid form, for example, solutions, syrups or suspensions. If provided in liquid form, the pharmaceutical preparations can be provided as a concentrated preparation to be diluted to a therapeutically effective concentration before use. Such liquid preparations can be prepared by conventional means with pharmaceutically acceptable additives such as suspending agents (e.g., sorbitol syrup, cellulose derivatives or hydrogenated edible fats); emulsifying agents (e.g., lecithin or acacia); non-aqueous vehicles (e.g., almond oil, oily esters, or fractionated vegetable oils); and preservatives (e.g., methyl or propyl-p-hydroxybenzoates or sorbic acid). In another example, pharmaceutical preparations can be presented in lyophilized form for reconstitution with water or other suitable vehicle before use.

Pharmaceutical compositions can include carriers such as a diluent, adjuvant, excipient, or vehicle with which the compositions (e.g. corticosteroid or anti-hyaluronan agent, such as a PEGylated hyaluronan-degrading enzymes) are administered. Examples of suitable pharmaceutical carriers are described in "Remington's Pharmaceutical Sciences" by E. W. Martin. Such compositions will contain a therapeutically effective amount of the compound or agent, generally in purified form or partially purified form, together with a suitable amount of carrier so as to provide the form for proper administration to the patient. Such pharmaceutical carriers can be sterile liquids, such as water and oils, including those of petroleum, animal, vegetable or synthetic origin, such as peanut oil, soybean oil, mineral oil, and sesame oil. Water is a typical carrier. Saline solutions and aqueous dextrose and glycerol solutions also can be employed as liquid carriers, particularly for injectable solutions. Compositions can contain along with an active ingredient: a diluent such as lactose, sucrose, dicalcium phosphate, or carboxymethylcellulose; a lubricant, such as magnesium stearate, calcium stearate and talc; and a binder such as starch, natural gums, such as gum acacia, gelatin, glucose, molasses, polyvinylpyrrolidine, celluloses and derivatives thereof, povidone, crospovidones and other such binders known to those of skill in the art. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, and ethanol. For example, suitable excipients are, for example, water, saline, dextrose, glycerol or ethanol. A composition, if desired, also can contain other minor amounts of non-toxic auxiliary substances such as wetting or emulsifying agents, pH buffering agents, stabilizers, solubility enhancers, and other such agents, such as for example, sodium acetate, sorbitan monolaurate, triethanolamine oleate and cyclodextrins.

Pharmaceutically acceptable carriers used in parenteral preparations include aqueous vehicles, nonaqueous vehicles, antimicrobial agents, isotonic agents, buffers, antioxidants, local anesthetics, suspending and dispersing agents, emulsifying agents, sequestering or chelating agents and other pharmaceutically acceptable substances. Examples of aqueous vehicles include Sodium Chloride Injection, Ringers Injection, Isotonic Dextrose Injection, Sterile Water Injection, Dextrose and Lactated Ringers Injection. Nonaqueous parenteral vehicles include fixed oils of vegetable origin, cottonseed oil, corn oil, sesame oil and peanut oil. Antimicrobial agents in bacteriostatic or fungistatic concentrations can be added to parenteral preparations packaged in multiple-dose containers, which include phenols or cresols, mercurials, benzyl alcohol, chlorobutanol, methyl and propyl p-hydroxybenzoic acid esters, thimerosal, benzalkonium chloride and benzethonium chloride. Isotonic agents include sodium chloride and dextrose. Buffers include phosphate and citrate. Antioxidants include sodium bisulfate. Local anesthetics include procaine hydrochloride. Suspending and dispersing agents include sodium carboxymethylcellulose, hydroxypropyl methylcellulose and polyvinylpyrrolidone. Emulsifying agents include Polysorbate 80 (TWEEN 80). A sequestering or chelating agent of metal ions include EDTA. Pharmaceutical carriers also include ethyl alcohol, polyethylene glycol and propylene glycol for water miscible vehicles and sodium hydroxide, hydrochloric acid, citric acid or lactic acid for pH adjustment.

Injectables can be prepared in conventional forms, either as liquid solutions or suspensions, solid forms suitable for solution or suspension in liquid prior to injection, or as emulsions. Preparations for intraprostatic administration include sterile solutions ready for injection, sterile dry soluble products, such as lyophilized powders, ready to be combined with a solvent just prior to use, including hypodermic tablets, sterile suspensions ready for injection, sterile dry insoluble products ready to be combined with a vehicle just prior to use, sterile emulsions. The solutions can be either aqueous or nonaqueous.

3. Dosages and Administration

Typically, the dose of an anti-hyaluronan agent, for example, a hyaluronan-degrading enzyme, is one that also achieves a therapeutic effect in the treatment of a hyaluronan associated disease or condition, such as cancer. Hence, compositions of an anti-hyaluronan agent, for example a hyaluronan-degrading enzyme, are included in an amount sufficient to exert a therapeutically useful effect. The composition containing the active agent can include a pharmaceutically acceptable carrier. The compositions of an anti-hyaluronan agent also can include a second therapeutic agent.

Therapeutically effective concentration of an anti-hyaluronan agent, for example a hyaluronan-degrading enzyme, can be determined empirically by testing the compounds in known in vitro and in vivo systems, such as the assays provided herein. For example, the concentration of an anti-hyaluronan agent, such as a hyaluronan-degrading enzyme or modified form thereof (e.g a PEGylated hyaluronan-degrading enzyme, such as PEGylated hyaluronidase) depends on absorption, inactivation and excretion rates, the physico-chemical characteristics, the dosage schedule, and amount administered as well as other factors known to those of skill in the art. For example, it is understood that the precise dosage and duration of treatment is a function of the tissue being treated, the disease or condition being treated, the route of administration, the patient or subject and the particular anti-hyaluronan agent and can be determined empirically using known testing protocols or by extrapolation from in vivo or in vitro test data and/or can be determined from known dosing regimes of the particular agent. The amount of an anti-hyaluronan agent, for example a hyaluronan-degrading enzyme or modified form thereof (e.g. a PEGylated hyaluronan-degrading enzyme, such as a PEGylated hyaluronidase), to be administered for the treatment of a disease or condition, for example a hyaluronan-associated disease or condition such as an HA-rich tumor, can be determined by standard clinical techniques. In addition, in vitro assays and animal models can be employed to help identify optimal dosage ranges. The precise dosage, which can be determined empirically, can depend on the particular enzyme, the route of administration, the type of disease to be treated and the seriousness of the disease.

For example, methods of using anti-hyaluronan agents, such as hyaluronan-degrading enzymes or modified forms thereof (e.g. PEGylated forms) for treatment of hyaluronan-associated diseases and conditions are well known in the art (see e.g. U.S. published application No. 20100003238 and International published PCT Appl. No. WO 2009/128917). Thus, dosages of an anti-hyaluronan agent, such as a hyaluronan-degrading enzyme for example a hyaluronidase, can be chosen based on standard dosing regimes for that agent under a given route of administration.

Examples of effective amounts of an anti-hyaluronan agent for treatment of a hyaluronan-associated disease or condition is a dose ranging from 0.01 pig to 100 g per kg of body weight. For example, an effective amount of an anti-hyaluronan agent is a dose ranging from 0.01 µg to 100 mg per kg of body weight, such as 0.01 µg to 1 mg per kg of body weight, 1 µg to 100 µg per kg of body weight, 1 µg to 10 µg per kg of body weight or 0.01 mg to 100 mg per kg of body weight. For example, effective amounts include at least or about at least or about or 0.01 µg, 0.05, 0.1, 0.5, 1, 2, 3, 4, 5, 6, 7, 8, 9, 10, 20, 25, 30, 35, 40, 45, 50, 55, 60, 65, 70, 75, 80, 85, 90, 95, 100, 200, 300, 400, 500, 600, 700, 800, 900 or 1000 µg/kg body weight Other examples of effective amounts include 0.01, 0.02, 0.03, 0.04, 0.05, 0.06, 0.07, 0.08, 0.09, 0.1, 0.2, 0.3, 0.4, 0.5, 0.6, 0.7, 0.8, 0.9, 1.0, 2, 3, 4, 5, 6, 7, 8, 9, 10, 20, 25, 30, 35, 40, 45, 50, 55, 60, 65, 70, 75, 80, 85, 90, 95 or 100 g/kg body weight. For example, an anti-hyaluronan agent, such as a hyaluronan-degrading enzyme for example a hyaluronidase (e.g. a PEGylated hyaluronidase such as a PEGPH20), can be administered at or about 0.1 µg/kg to 1 mg/kg, for example 0.5 µg/kg to 100 µg/kg, 0.75 µg/kg to 15 µg/kg, 0.75 µg/kg to 7.5 µg/kg or 1.0 µg/kg to 3.0 µg/kg. In other examples, an anti-hyaluronan agent such as a hyaluronan-degrading enzyme for example a hyaluornidase (e.g. a PEGylated hyaluronidase such as a PEGPH20), can be administered at or 1 mg/kg to 500 mg/kg, for example, 100 mg/kg to 400 mg/kg, such as 200 mg/kg. For example, compositions contain 0.5 mg to 100 grams of anti-hyaluronan agent, for example, 20 µg to 1 mg, such as 100 µg to 0.5 mg or can contain 1 mg to 1 gram, such as 5 mg to 500 mg.

For example, agents and treatments for treatment of hyaluronan-associated diseases and conditions, such as anti-cancer agents, are well known in the art (see e.g. U.S. published application No. 20100003238 and International published PCT Appl. No. WO 2009/128917). Thus, dosages of a hyaluronan-degrading enzyme, for example a hyaluronidase, or other second agents in a composition can be chosen based on standard dosing regimes for that agent under a given route of administration.

Examples of effective amounts of a hyaluronan-degrading enzyme is a dose ranging from 0.01 µg to 100 g per kg of body weight. For example, an effective amount of a hyaluronan-degrading enzyme is a dose ranging from 0.01 µg to 100 mg per kg of body weight, such as 0.01 µg to 1 mg per kg of body weight, 1 µg to 100 µg per kg of body weight, 1 µg to 10 µg per kg of body weight or 0.01 mg to 100 mg per kg of body weight. For example, effective amounts include at least or about at least or about or 0.01 µg, 0.05, 0.1, 0.5, 1, 2, 3, 4, 5, 6, 7, 8, 9, 10, 20, 25, 30, 35, 40, 45, 50, 55, 60, 65, 70, 75, 80, 85, 90, 95, 100, 200, 300, 400, 500, 600, 700, 800, 900 or 1000 µg/kg body weight Other examples of effective amounts include 0.01, 0.02, 0.03, 0.04, 0.05, 0.06, 0.07, 0.08, 0.09, 0.1, 0.2, 0.3, 0.4, 0.5, 0.6, 0.7, 0.8, 0.9, 1.0, 2, 3, 4, 5, 6, 7, 8, 9, 10, 20, 25, 30, 35, 40, 45, 50, 55, 60, 65, 70, 75, 80, 85, 90, 95 or 100 g/kg body weight. For example, a hyaluronan-degrading enzyme for example a hyaluronidase (e.g. a PEGylated hyaluronidase such as a PEGPH20), can be administered at or about 0.1 µg/kg to 1 mg/kg, for example 0.5 µg/kg to 100 µg/kg, 0.75 µg/kg to 15 µg/kg, 0.75 µg/kg to 7.5 µg/kg or 1.0 µg/kg to 3.0 µg/kg. In other examples, a hyaluronan-degrading enzyme for example a hyaluomidase (e.g. a PEGylated hyaluronidase such as a PEGPH20), can be administered at or 1 mg/kg to 500 mg/kg, for example, 100 mg/kg to 400 mg/kg, such as 200 mg/kg. Generally, compositions contain 0.5 mg to 100 grams of a hyaluronan-degrading enzyme, for example, 20 µg to 1 mg, such as 100 µg to 0.5 mg or can contain 1 mg to 1 gram, such as 5 mg to 500 mg.

The dose or compositions can be for single dosage administration or for multiple dosage administration. The dose or composition can be administered in a single administration once, several times a week, twice weekly, every 15 days, 16 days, 17, 18, 19, 20, 21, 22, 23, 24, 25, 26, 27, 28, 29, or 30 days, once monthly, several times a year or yearly. In other examples, the dose or composition an be divided up and administered once, several times a week, twice weekly, every 15 days, 16 days, 17, 18, 19, 20, 21, 22, 23, 24, 25, 26, 27, 28, 29, or 30 days, once monthly, several times a year or yearly.

Hyaluronan-degrading enzyme compositions can be formulated as liquid compositions or can be lyophilized. The compositions also can be formulated as a tablet or capsule.

Provided below is description of dosages and dosage regimines of exemplary hyaluronan-degrading enzymes conjugated to a polymer (e.g. PEGylated) for use in the methods herein. The hyaluronan-degrading enzymes can be used alone in a single agent therapy or in combination with other agents for use in treating an HA-associated disease or condition, such as cancer. As discussed elsewhere herein, in particular examples of the methods and uses herein, the agents can be administered in combination with a corticosteroid in order to ameliorate a side-effect associated with treatment of the anti-hyaluronan-agent.

a. Administration of a PEGylated Hyaluronan-Degrading Enzyme

A hyaluronan-degrading enzyme, such as a PEGylated hyaluronan-degrading enzyme (e.g. a hyaluronidase), can be administered systemically, for example, intravenously (IV), intramuscularly, or by any another systemic route. In particular examples, lower doses can be given locally. For example, local administration of a hyaluronan-degrading enzyme, such as a PEGylated hyaluronan-degrading enzyme for example a PEGylated hyaluronidase (e.g. PH20) includes intratumoral administration, arterial injection (e.g. hepatic artery), intraperitoneal administration, intravesical administration and other local routes used for cancer therapy that can increase local action at a lower absolute dose.

Exemplary dosage range is at or about 0.3 Units/kg to 320,000 Units/kg, such as 10 Units/kg to 320,000 Units/kg of a PEGylated hyaluronidase, or a functionally equivalent amount of another PEGylated hyaluronan-degrading enzyme. It is understood herein that a unit of activity is normalized to a standard activity, for example, an activity as measured in a microturbidity assay assaying hyaluronidase activity. A PEGylated soluble hyaluronidase can exhibit lower activity per mg of total protein, i.e. exhibits a lower specific activity, compared to a native soluble hyaluronidase not so conjugated. For example, an exemplary rHuPH20 preparation exhibits a specific activity of 120,000 Units/mg, while a PEGylated form of rHuPH20 exhibits a specific activity of at or about 32,000 Units/mg. Typically, a PEGylated form of a hyaluronan-degrading enzyme, such as a hyaluronidase for example rHuPH20, exhibits a specific activity within the range of between at or about 18,000 and at or about 45,000 U/mg. In one example, the PEG-hyaluronan-degrading enzyme can be provided as a stock solution for example, at 3.5 mg/mL at 112,000 U/mL (32,000 U/mg), with a PEG to protein molar ratio between 5:1 and 9:1, for example, 7:1, or can be provided in a less concentrated form. For purposes herein, dosages can be with reference to Units.

For example, PEGylated hyaluronan-degrading enzyme, such as a hyaluronidase, for example PEGPH20, can be administered intravenously twice weekly, once weekly or once every 21 days. Typically, the PEGylated hyaluronan-degrading enzyme is administered twice weekly. The cycle of administration can be for a defined period, generally for 3 weeks or 4 weeks. The cycle of administration can be repeated in a dosage regime for more than one month, 2 months, 3 months, 4 months, 5 months, 6 months, 7 months, 8 months, 9 months, 10 months, 11 months, 1 year or more. Generally, the cycle of administration is repeated at the discretion of a treating physician, and can depend on factors such as remission of the disease or condition, severity of the disease or condition, adverse events and other factors. In other examples, in subsequent cycles of administration, the hyaluronan-degrading enzyme can be administered less frequently. For example, in a first cycle the hyaluronan-degrading enzyme is administered twice weekly for four weeks, and in subsequent cycles of administration the hyaluronan-degrading enzyme is administered once weekly or once every two weeks, once every 3 weeks (e.g. once every 21 days) or once every 4 weeks. As described herein, the dose or dosing regime of corticosteroid is dependent on the dosing regime of hyaluronan-degrading enzyme.

While dosages can vary depending on the disease and patient, the hyaluronan-degrading enzyme, such as a PEGylated hyaluronidase, is generally administered in an amount that is or is about in the range of from 0.01 µg/kg, such as 0.0005 mg/kg (0.5 µg/kg) to 10 mg/kg (320,000 U/kg), for example, 0.02 mg/kg to 1.5 mg/kg, for example, 0.05 mg/kg. The PEGylated hyaluronidase can be administered, for example, at a dosage of at or about 0.0005 mg/kg (of the subject), 0.0006 mg/kg, 0.0007 mg/kg, 0.0008 mg/kg, 0.0009 mg/kg, 0.001 mg/kg, 0.0016 mg/kg, 0.002 mg/kg, 0.003 mg/kg, 0.004 mg/kg, 0.005 mg/kg, 0.006 mg/kg, 0.007 mg/kg, 0.008 mg/kg, 0.009 mg/kg, 0.01 mg/kg, 0.016 mg/kg, 0.02 mg/kg, 0.03 mg/kg, 0.04 mg/kg, 0.05 mg/kg, 0.06 mg/kg, 0.07 mg/kg, 0.08 mg/kg, 0.09 mg/kg, 0.1 mg/kg, 0.15 mg/kg, 0.2 mg/kg, 0.25 mg/kg, 0.30 mg/kg, 0.35 mg/kg, 0.40 mg/kg, 0.45 mg/kg, 0.5 mg/kg, 0.55 mg·kg, 0.6 mg/kg, 0.7 mg/kg, 0.8 mg/kg, 0.9 mg/kg, 1.0 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2 mg/kg, 2.5 mg/kg, 3 mg/kg, 3.5 mg/kg, 4 mg/kg, 4.5 mg/kg, 5 mg/kg, 5.5 mg/kg, 6 mg/kg, 6.5 mg/kg, 7 mg/kg, 7.5 mg/kg, 8 mg/kg, 8.5 mg/kg, 9 mg/kg, 9.5 mg/kg, 10 mg/kg, 11 mg/kg, 12 mg/kg, 13 mg/kg, 14 mg/kg, 15 mg/kg, 16 mg/kg, 17 mg/kg, 18 mg/kg, 19 mg/kg, 20 mg/kg, 21 mg/kg, 22 mg/kg, 23 mg/kg, 24 mg/kg, 25 mg/kg, or more is administered, to an average adult human subject, typically weighing about 70 kg to 75 kg. In particular examples, the hyaluronan-degrading enzyme is administered in lower amounts such as less than 20 µg/kg, for example 0.01 µg/kg to 15 µg/kg, 0.05 µg/kg to 10 µg/kg, 0.75 µg/kg to 7.5 µg/kg or 1.0 µg/kg to 3.0 µg/kg.

A hyaluronan-degrading enzyme, such as a PEGylated hyaluronidase (e.g. PH20), provided herein, for example, PEGPH20, can be administered at or about 1 Unit/kg to 800,000 Units/kg, such as 10 to 800,000 Units/kg, 10 to 750,000 Units/kg, 10 to 700,000 Units/kg, 10 to 650,000 Units/kg, 10 to 600,000 Units/kg, 10 to 550,000 Units/kg, 10 to 500,000 Units/kg, 10 to 450,000 Units/kg, 10 to 400,000 Units/kg, 10 to 350,000 Units/kg, 10 to 320,000 Units/kg, 10 to 300,000 Units/kg, 10 to 280,000 Units/kg, 10 to 260,000 Units/kg, 10 to 240,000 Units/kg, 10 to 220,000 Units/kg, 10 to 200,000 Units/kg, 10 to 180,000 Units/kg, 10 to 160,000 Units/kg, 10 to 140,000 Units/kg, 10 to 120,000 Units/kg, 10 to 100,000 Units/kg, 10 to 80,000 Units/kg, 10 to 70,000 Units/kg, 10 to 60,000 Units/kg, 10 to 50,000 Units/kg, 10 to 40,000 Units/kg, 10 to 30,000 Units/kg, 10 to 20,000 Units/kg, 10 to 15,000 Units/kg, 10 to 12,800 Units/kg, 10 to 10,000 Units/kg, 10 to 9,000 Units/kg, 10 to 8,000 Units/kg, 10 to 7,000 Units/kg, 10 to 6,000 Units/kg, 10 to 5,000 Units/kg, 10 to 4,000 Units/kg, 10 to 3,000 Units/kg, 10 to 2,000 Units/kg, 10 to 1,000 Units/kg, 10 to 900 Units/kg, 10 to 800 Units/kg, 10 to 700 Units/kg, 10 to 500 Units/kg, 10 to 400 Units/kg, 10 to 300 Units/kg, 10 to 200 Units/kg, 10 to 100 Units/kg, 16 to 600,000 Units/kg, 16 to 500,000 Units/kg, 16 to 400,000 Units/kg, 16 to 350,000 Units/kg, 16 to 320,000 Units/kg, 16 to 160,000 Units/kg, 16 to 80,000 Units/kg, 16 to 40,000 Units/kg, 16 to 20,000 Units/kg, 16 to 16,000 Units/kg, 16 to 12,800 Units/kg, 16 to 10,000 Units/kg, 16 to 5,000 Units/kg, 16 to 4,000 Units/kg, 16 to 3,000 Units/kg, 16 to 2,000 Units/kg, 16 to 1,000 Units/kg, 16 to 900 Units/kg, 16 to 800

Units/kg, 16 to 700 Units/kg, 16 to 500 Units/kg, 16 to 400 Units/kg, 16 to 300 Units/kg, 16 to 200 Units/kg, 16 to 100 Units/kg, 160 to 12,800 Units/kg, 160 to 8,000 Units/kg, 160 to 6,000 Units/kg, 160 to 4,000 Units/kg, 160 to 2,000 Units/kg, 160 to 1,000 Units/kg, 160 to 500 Units/kg, 500 to 5000 Units/kg, 1000 to 100,000 Units/kg or 1000 to 10,000 Units/kg, of the mass of the subject to whom it is administered. In some examples, a hyaluronan-degrading enzyme, such as a PEGylated hyaluronidase (e.g. PH20), provided herein, for example, PEGPH20, can be administered at or about 1 Unit/kg to 1000 Units/kg, 1 Units/kg to 500 Units/kg or 10 Units/kg to 50 Units/kg.

Generally, where the specific activity of the PEGylated hyaluronidase is or is about 18,000 U/mg to 45,000 U/mg, generally at or about 1 Units/kg (U/kg), 2 U/kg, 3 U/kg, 4 U/kg, 5 U/kg, 6 U/kg, 7 U/kg, 8 U/kg, 8 U/kg 10 U/kg, 16 U/kg, 32 U/kg, 64 U/kg, 100 U/kg, 200 U/kg, 300 U/kg, 400 U/kg, 500 U/kg, 600 U/kg, 700 U/kg, 800 U/kg, 900 U/kg, 1,000 U/kg, 2,000 U/kg, 3,000 U/kg, 4,000 U/kg, 5,000 U/kg, 6,000 U/kg, 7,000 U/kg, 8,000 U/kg, 9,000 U/kg, 10,000 U/kg, 12,800 U/kg, 20,000 U/kg, 32,000 U/kg, 40,000 U/kg, 50,000 U/kg, 60,000 U/kg, 70,000 U/kg, 80,000 U/kg, 90,000 U/kg, 100,000 U/kg, 120,000 U/kg, 140,000 U/kg, 160,000 U/kg, 180,000 U/kg, 200,000 U/kg, 220,000 U/kg, 240,000 U/kg, 260,000 U/kg, 280,000 U/kg, 300,000 U/kg, 320,000 U/kg, 350,000 U/kg, 400,000 U/kg, 450,000 U/kg, 500,000 U/kg, 550,000 U/kg, 600,000 U/kg, 650,000 U/kg, 700,000 U/kg, 750,000 U/kg, 800,000 U/kg or more, per mass of the subject, is administered.

In some aspects, the PEGylated hyaluronan-degrading enzyme is formulated and dosed to maintain at least 3 U/mL of the PEGylated hyaluronidase in the plasma (see e.g. published U.S. Patent App. No. US20100003238 and published International Patent App. No. WO2009128917). For example, the PEGylated soluble hyaluronidase is formulated for systemic administration in a sufficient amount to maintain at least or about 3 U/mL in the plasma, generally 3 U/mL-12 U/mL or more, for example, from at least or about or at a level of 4 U/mL, 5 U/mL, 6 U/mL, 7 U/mL, 8 U/mL, 9 U/mL, 10 U/mL, 11 U/mL, 12 U/mL, 13 U/mL, 14 U/mL, 15 U/mL, 16 U/mL, 17 U/mL, 18 U/mL, 19 U/mL, 20 U/mL, 25 U/mL, 30 U/mL, 35 U/mL, 40 U/mL, 45 U/mL, 50 U/mL or more. Generally, for purposes herein to maintain at least 3 U/mL of the hyaluronidase in plasma, at or about 0.02 mg/kg (of the subject), 0.03 mg/kg, 0.04 mg/kg, 0.05 mg/kg, 0.06 mg/kg, 0.07 mg/kg, 0.08 mg/kg, 0.09 mg/kg, 0.1 mg/kg, 0.15 mg/kg, 0.2 mg/kg, 0.25 mg/kg, 0.30 mg/kg, 0.35 mg/kg, 0.40 mg/kg, 0.45 mg/kg, 0.5 mg/kg, 0.55 mg·kg, 0.6 mg/kg, 0.7 mg/kg, 0.8 mg/kg, 0.9 mg/kg, 1.0 mg/kg, 1.1 mg/kg, 1.2 mg/kg, 1.3 mg/kg, 1.4 mg/kg, 1.5 mg/kg or more is administered. Generally, where the specific activity of the modified hyaluronidase is or is about 20,000 U/mg to 60,000 U/mg, generally at or about 35,000 U/mg, 60,000 U; 70,000 U; 80,000 U; 90,000 U; 100,000 U; 200,000 U; 300,000 U; 400,000 U; 500,000 U; 600,000 U; 700,000 U; 800,000 U; 900,000 U; 1,000,000 U; 1,500,000 U; 2,000,000 U; 2,500,000 U; 3,000,000 U; 3,500,000 U; 4,000,000 U or more is administered. To maintain such levels, administration can be daily, several times a week, twice weekly, weekly or monthly.

It is within the level of one of skill in the art to determine the amounts of PEGylated hyaluron degrading enzyme, for example, PEGylated PH20, to maintain at least 3 U/mL of the hyaluronidase in the blood. The level of hyaluronidase in the blood can be monitored over time in order to ensure that a sufficient amount of the hyaluronidase is present in the blood. Any assay known to one of skill in the art to measure the hyaluronidase in the plasma can be performed. For example, a microturbidity assay or enzymatic assay described in the Examples herein can be performed on protein in plasma. It is understood that plasma normally contains hyaluronidase enzymes. Such plasma hyaluronidase enzymes typically have activity at an acidic pH (U.S. Pat. No. 7,105,330). Hence, before treatment of with a modified enzyme, the plasma levels of hyaluronidase should be determined and used as a baseline. Subsequent measurements of plasma hyaluronidase levels after treatment can be compared to the levels before treatments. Alternatively, the assay can be performed under pH conditions that suppress endogenous lysosomal hyaluronidase activity in plasma, which normally exhibits activity at acidic pH. Thus, where the modified soluble hyaluronidase is active at neutral pH (e.g. human PH20), only the level of the modified neutral-active soluble hyaluronidase is measured.

In other examples, the PEGylated hyaluronan-degrading enzyme is formulated and administered at a lower dose, which is found herein to have therapeutic effects to treat a hyaluronan-associated disease or conditions absent a detectable level of hyaluronidase maintained in the blood. For example, the PEGylated soluble hyaluronidase is administered in an amount that is less than 20 µg/kg, for example 0.01 µg/kg to 15 µg/kg, 0.05 µg/kg to 10 µg/kg, 0.75 µg/kg to 7.5 µg/kg or 1.0 µg/kg to 3.0 µg/kg, such as at or about 0.01 µg/kg (of the subject), 0.02 µg/kg, 0.03 µg/kg, 0.04 µg/kg, 0.05 µg/kg, 1.0 µg/kg, 1.5 µg/kg, 2.0 µg/kg, 2.5 µg/kg, 3.0 µg/kg, 3.5 µg/kg, 4.0 µg/kg, 4.5 µg/kg, 5.0 µg/kg, 5.5 µg/kg, 6.0 µg/kg, 7.0 µg/kg, 7.5 µg/kg, 8.0 µg/kg, 9.0 µg/kg, 10.0 µg/kg, 12.5 µg/kg or 15 µg/kg. Generally, where the specific activity of the modified hyaluronidase is or is about 20,000 U/mg to 60,000 U/mg, generally at or about 35,000 U/mg, 200 Units to 50,000 (U) is administered, such as 200 U, 300 U; 400 U; 500 U; 600 U; 700 U; 800 U; 900 U; 1,000 U; 1250 U; 1500 U; 2000 U; 3000 U; 4000 U; 5,000 U; 6,000 U; 7,000 U; 8,000 U; 9,000 U; 10,000 U; 20,000 U; 30,000 U; 40,000 U; or 50,000 U is administered. To maintain such levels, administration can be daily, several times a week, twice weekly, weekly or monthly.

Typically, volumes of injections or infusions of PEGylated hyaluronidase contemplated herein are from at or about 0.5 mL, 1 mL, 2 mL, 3 mL, 4 mL, 5 mL, 6 mL, 7 mL, 8 mL, 9 mL, 10 mL, 15 mL, 20 mL, 30 mL, 40 mL, 50 mL or more. The PEGylated hyaluronan-degrading enzyme, such as a PEGylated hyaluronidase can be provided as a stock solution at or about 50 U/mL, 100 U/mL, 150 U/mL, 200 U/mL, 400 U/mL or 500 U/mL (or a functionally equivalent amount) or can be provided in a more concentrated form, for example at or about 1000 U/mL, 2000 Units/mL, 3000 U/mL, 4000 U/mL, 5000 U/mL, 6000 U/mL, 7000 U/mL, 8000 U/mL, 9000 U/mL, 10,000 U/mL, 11,000 U/mL, 12,000 U/mL, or 12,800 U/mL, for use directly or for dilution to the effective concentration prior to use. The volume of PEGylated hyaluronan-degrading enzyme, such as PEGylated hyaluronidase, administered is a function of the dosage required, but can be varied depending on the concentration of a hyaluronan-degrading enzyme, such as soluble hyaluronidase, stock formulation available. For example, it is contemplated herein that the PEGylated hyaluronan-degrading enzyme, such as PEGylated hyaluronidase, is not administered in volumes greater than about 50 mL, and typically is administered in a volume of 5-30 mL, generally in a volume that is not greater than about 10 mL. The PEGylated hyaluronan-degrading enzyme, such as a PEGylated hyaluronidase, can be provided as a liquid or lyophilized formulation. Lyophilized formulations are ideal for storage of large unit doses of PEGylated hyaluronan-degrading enzymes.

4. Combination Treatments

Anti-hyaluronan agents, such as a hyaluronan-degrading enzymes or modified form thereof (e.g. a PEGylated hyaluronan-degrading enzyme or PEGylated hyaluronaidase such as PEGPH20) can be administered in a combination treatment, for example, for the treatment of a hyaluronan-associated disease or condition, such as cancer. Compositions of an anti-hyaluronan agent can be co-formulated or co-administered together with, prior to, intermittently with, or subsequent to, other therapeutic or pharmacologic agents or treatments, such as procedures, for example, agents or treatments to treat a hyaluronan associated disease or condition, for example hyaluronan-associated cancers. Such agents include, but are not limited to, other biologics, anti-cancer agents, small molecule compounds, dispersing agents, anesthetics, vasoconstrictors and surgery, and combinations thereof. Such other agents and treatments that are available for the treatment of a disease or condition, including all those exemplified herein, are known to one of skill in the art or can be empirically determined.

A preparation of a second agent or agents or treatment or treatments can be administered at once, or can be divided into a number of smaller doses to be administered at intervals of time. Selected agent/treatment preparations can be administered in one or more doses over the course of a treatment time for example over several hours, days, weeks, or months. In some cases, continuous administration is useful. It is understood that the precise dosage and course of administration depends on the indication and patient's tolerability. Generally, dosing regimes for second agents/treatments herein are known to one of skill in the art.

In one example, an anti-hyaluronan agent, for example a hyaluronan-degrading enzyme or modified form thereof conjugated to a polymer (e.g. a PEGylated hyaluronan-degrading enzyme, such as PEGylated hyaluronidase), is administered with a second agent or treatment for treating the disease or condition. In one example, an anti-hyaluronan agent, for example a hyaluronan-degrading enzyme or a modified form thereof conjugated to a polymer (e.g. a PEGylated hyaluronan-degrading enzyme) and second agent or treatment can be co-formulated and administered together. In another example, an anti-hyaluronan agent, for example a hyaluronan-degrading enzyme or modified form thereof conjugated to a polymer (e.g. a PEGylated hyaluronan-degrading enzyme, such as PEGylated hyaluronidase) is administered subsequently, intermittently or simultaneously with the second agent or treatment preparation. Generally, an anti-hyaluronan agent, for example a hyaluronan-degrading enzyme (e.g. a PEGylated hyaluronan-degrading enzyme) is administered prior to administration of the second agent or treatment preparation to permit the agent to reduce the level or amount of tissue- or cell-associated hyaluronan. For example, a hyaluronan-degrading enzyme, for example a PEGylated hyaluronan-degrading enzyme, is administered prior to a second agent or treatment to permit the enzyme to reduce or degrade the hyaluronic acid in a cell, tissue or fluid of the subject, such as, for example, the interstitial space, extracellular matrix, tumor tissue, blood or other tissue. For example, an anti-hyaluronan agent, such as a hyaluronan-degrading enzyme or modified form thereof conjugated to a polymer (e.g. a PEGylated hyaluronan-degrading enzyme, such as soluble hyaluronidase) can be administered 0.5 minutes, 1 minute, 2 minutes, 3 minutes, 4 minutes, 5 minutes, 6 minutes, 7 minutes, 8 minutes, 9 minutes, 10 minutes, 20 minutes, 30 minutes, 1 hour or more prior to administration of the second agent preparation. In some examples, an anti-hyaluronan agent, for example a hyaluronan-degrading enzyme or modified form thereof conjugated to a polymer (e.g. a PEGylated hyaluronan-degrading enzyme) is administered together with the second agent preparation. As will be appreciated by those of skill in the art, the desired proximity of co-administration depends in significant part in the effective half lives of the agents in the particular tissue setting, and the particular disease being treated, and can be readily optimized by testing the effects of administering the agents at varying times in suitable models, such as in suitable animal models. In some situations, the optimal timing of administration of the anti-hyaluronan agent, for example a hyaluronan-degrading enzyme or modified form thereof conjugated to a polymer (e.g. a PEGylated hyaluronan-degrading enzyme, such as a PEGylated hyaluronidase) will exceed 60 minutes.

For example, an anti-hyaluronan agent, for example a hyaluronan-degrading enzyme, can be administered in conjunction with anti-cancer agents (see e.g. U.S. Publication No. US2010-0003238). The anticancer agent(s) or treatment(s) for use in combination with a hyaluronan-degrading enzyme include, but are not limited to, surgery, radiation, drugs, chemotherapeutics, polypeptides, antibodies, peptides, small molecules or gene therapy vectors, viruses or DNA.

In other examples, the methods of treatment provided herein include methods of administering one or more additional anti-hyaluronan agents for therapy in addition to a hyaluronan-degrading enzyme. Anti-hyaluronan agents include any agent that reduces or eliminates the accumulation or HA in a tumor. Such agents include, but are not limited to, the hyaluronan-degrading enzymes described herein and also agents that inhibit synthesis of HA. For example, anti-hyaluronan agents that inhibit hyaluronan synthesis include antisense or sense molecules against an has gene. Such antisense or sense inhibition is typically based upon hydrogen bonding-based hybridization of oligonucleotide strands or segments such that at least one strand or segment is cleaved, degraded or otherwise rendered inoperable. In other examples, post-transcriptional gene silencing (PTGS), RNAi, ribozymes and DNAzymes can be employed. It is within the level of one skill in the art to generate such constructs based on the sequence of HAS1 (set forth in SEQ ID NO: 195), HAS2 (set forth in SEQ ID NO:196) or HAS3 (set forth in SEQ ID NO:197 or 198). It is understood in the art that the sequence of an antisense or sense compound need not be 100% complementary to that of its target nucleic acid to be specifically hybridizable. An oligonucleotide may hybridize over one or more segments such that intervening or adjacent segments are not involved in the hybridization event (e.g. a loop structure or hairpin structure). Generally, the antisense or sense compounds have at least 70% sequence complementarity to a target region within the target nucleic acid, for example, 75% to 100% complementarity, such as 75%, 80%, 85%, 90%, 95% or 100%. Exemplary sense or antisense molecules are known in the art (see e.g. Chao et al. (2005) *J. Biol. Chem.* 280:27513-27522; Simpson et al. (2002) *J. Biol. Chem.* 277:10050-10057; Simpson et al. (2002) *Am. J Path.* 161:849; Nishida et al. (1999) *J. Biol. Chem.* 274:21893-21899; Edward et al. (2010) *British J Dermatology* 162:1224-1232; Udabage et al. (2005) *Cancer Res.* 65:6139; and published U.S. Patent application No. US20070286856). Another exemplary anti-hyaluronan agent that is an HA synthesis inhibitor is 4-Methylumbelliferone (4-MU; 7-hydroxy-4-methylcoumarin) or a derivative thereof. 4-MU acts by reducing the UDP-GlcUA precursor pool that is required for HA synthesis. Further exemplary anti-hyaluronan agents are tyrosine kinase inhibitors, such as Leflunomide (Arava), genistein or erbstatin.

In some examples, a corticosteroid can be administered to ameliorate side effects or adverse events of a hyaluronan-degrading enzyme in the combination therapy (see e.g. U.S. patent application Ser. No. 13/135,817). In some examples, the glucocorticoid is selected from among cortisones, dexamethasones, hydrocortisones, methylprednisolones, prednisolones and prednisones. In a particular example, the glucocorticoid is dexamethasone. Typically, the corticosteroid is administered orally, although any method of administration of the corticosteroid is contemplated. Typically, the glucocorticoid is administered at an amount between at or about 0.4 and 20 mgs, for example, at or about 0.4 mgs, 0.5 mgs, 0.6 mgs, 0.7 mgs, 0.75 mgs, 0.8 mgs, 0.9 mgs, 1 mg, 2 mgs, 3 mgs, 4 mgs, 5 mgs, 6 mgs, 7 mgs, 8 mgs, 9 mgs, 10 mgs, 11 mgs, 12 mgs, 13 mgs, 14 mgs, 15 mgs, 16 mgs, 17 mgs, 18 mgs, 19 mgs or 20 mgs per dose.

F. METHODS OF PRODUCING NUCLEIC ACIDS AND ENCODED POLYPEPTIDES OF HYALURONAN BINDING PROTEINS AND HYALURONAN-DEGRADING ENZYMES

Polypeptides of a hyaluronan binding protein for use in the compositions and methods provided or a hyaluronan-degrading enzyme, such as a soluble hyaluronidase, for treatment set forth herein, can be obtained by methods well known in the art for protein purification and recombinant protein expression. Any method known to those of skill in the art for identification of nucleic acids that encode desired genes can be used. Any method available in the art can be used to obtain a full length (i.e., encompassing the entire coding region) cDNA or genomic DNA clone encoding a hyaluronan binding protein or a hyaluronidase, such as from a cell or tissue source. Modified or variant hyaluronan binding proteins or hyaluronidases, can be engineered from a wildtype polypeptide, such as by site-directed mutagenesis.

Polypeptides can be cloned or isolated using any available methods known in the art for cloning and isolating nucleic acid molecules. Such methods include PCR amplification of nucleic acids and screening of libraries, including nucleic acid hybridization screening, antibody-based screening and activity-based screening.

Methods for amplification of nucleic acids can be used to isolate nucleic acid molecules encoding a desired polypeptide, including for example, polymerase chain reaction (PCR) methods. A nucleic acid containing material can be used as a starting material from which a desired polypeptide-encoding nucleic acid molecule can be isolated. For example, DNA and mRNA preparations, cell extracts, tissue extracts, fluid samples (e.g. blood, serum, saliva), samples from healthy and/or diseased subjects can be used in amplification methods. Nucleic acid libraries also can be used as a source of starting material. Primers can be designed to amplify a desired polypeptide. For example, primers can be designed based on expressed sequences from which a desired polypeptide is generated. Primers can be designed based on back-translation of a polypeptide amino acid sequence. Nucleic acid molecules generated by amplification can be sequenced and confirmed to encode a desired polypeptide.

Additional nucleotide sequences can be joined to a polypeptide-encoding nucleic acid molecule, including linker sequences containing restriction endonuclease sites for the purpose of cloning the synthetic gene into a vector, for example, a protein expression vector or a vector designed for the amplification of the core protein coding DNA sequences. Furthermore, additional nucleotide sequences specifying functional DNA elements can be operatively linked to a polypeptide-encoding nucleic acid molecule. Examples of such sequences include, but are not limited to, promoter sequences designed to facilitate intracellular protein expression, and secretion sequences, for example heterologous signal sequences, designed to facilitate protein secretion. Such sequences are known to those of skill in the art. Additional nucleotide residues sequences such as sequences of bases specifying protein binding regions also can be linked to enzyme-encoding nucleic acid molecules. Such regions include, but are not limited to, sequences of residues that facilitate or encode proteins that facilitate uptake of an enzyme into specific target cells, or otherwise alter pharmacokinetics of a product of a synthetic gene. For example, enzymes can be linked to PEG moieties.

In addition, tags or other moieties can be added, for example, to aid in detection or affinity purification of the polypeptide. For example, additional nucleotide residues sequences such as sequences of bases specifying an epitope tag or other detectable marker also can be linked to enzyme-encoding nucleic acid molecules. Exemplary of such sequences include nucleic acid sequences encoding a His tag (e.g., 6×His, HHHHHH; SEQ ID NO:54) or Flag Tag (DYKDDDDK; SEQ ID NO:55).

The identified and isolated nucleic acids can then be inserted into an appropriate cloning vector. A large number of vector-host systems known in the art can be used. Possible vectors include, but are not limited to, plasmids or modified viruses, but the vector system must be compatible with the host cell used. Such vectors include, but are not limited to, bacteriophages such as lambda derivatives, or plasmids such as pCMV4, pBR322 or pUC plasmid derivatives or the Bluescript vector (Stratagene, La Jolla, Calif.). Other expression vectors include the HZ24 expression vector exemplified herein. The insertion into a cloning vector can, for example, be accomplished by ligating the DNA fragment into a cloning vector which has complementary cohesive termini. Insertion can be effected using TOPO cloning vectors (Invitrogen, Carlsbad, Calif.). If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized oligonucleotides encoding restriction endonuclease recognition sequences. In an alternative method, the cleaved vector and protein gene can be modified by homopolymeric tailing. Recombinant molecules can be introduced into host cells via, for example, transformation, transfection, infection, electroporation and sonoporation, so that many copies of the gene sequence are generated.

In specific embodiments, transformation of host cells with recombinant DNA molecules that incorporate the isolated protein gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA.

1. Vectors and Cells

For recombinant expression of one or more of the desired proteins, such as any hyaluronan binding protein or hyaluronan-degrading enzyme described herein, the nucleic acid containing all or a portion of the nucleotide sequence encoding the protein can be inserted into an appropriate expression vector, i.e., a vector that contains the necessary elements for the transcription and translation of the inserted protein coding sequence. The necessary transcriptional and translational signals also can be supplied by the native promoter for enzyme genes, and/or their flanking regions.

Also provided are vectors that contain a nucleic acid encoding the enzyme. Cells containing the vectors also are provided. The cells include eukaryotic and prokaryotic cells, and the vectors are any suitable for use therein.

Prokaryotic and eukaryotic cells, including endothelial cells, containing the vectors are provided. Such cells include bacterial cells, yeast cells, fungal cells, Archea, plant cells, insect cells and animal cells. The cells are used to produce a protein thereof by growing the above-described cells under conditions whereby the encoded protein is expressed by the cell, and recovering the expressed protein. For purposes herein, for example, the enzyme can be secreted into the medium.

Provided are vectors that contain a sequence of nucleotides that encodes the hyaluronan-degrading enzyme polypeptide, in some examples a soluble hyaluronidase polypeptide, coupled to the native or heterologous signal sequence, as well as multiple copies thereof. The vectors can be selected for expression of the enzyme protein in the cell or such that the enzyme protein is expressed as a secreted protein.

A variety of host-vector systems can be used to express the protein coding sequence. These include but are not limited to mammalian cell systems infected with virus (e.g. vaccinia virus, adenovirus and other viruses); insect cell systems infected with virus (e.g. baculovirus); microorganisms such as yeast containing yeast vectors; or bacteria transformed with bacteriophage, DNA, plasmid DNA, or cosmid DNA. The expression elements of vectors vary in their strengths and specificities. Depending on the host-vector system used, any one of a number of suitable transcription and translation elements can be used.

Any methods known to those of skill in the art for the insertion of DNA fragments into a vector can be used to construct expression vectors containing a chimeric gene containing appropriate transcriptional/translational control signals and protein coding sequences. These methods can include in vitro recombinant DNA and synthetic techniques and in vivo recombinants (genetic recombination). Expression of nucleic acid sequences encoding protein, or domains, derivatives, fragments or homologs thereof, can be regulated by a second nucleic acid sequence so that the genes or fragments thereof are expressed in a host transformed with the recombinant DNA molecule(s). For example, expression of the proteins can be controlled by any promoter/enhancer known in the art. In a specific embodiment, the promoter is not native to the genes for a desired protein. Promoters which can be used include but are not limited to the SV40 early promoter (Bernoist and Chambon, *Nature* 290:304-310 (1981)), the promoter contained in the 3' long terminal repeat of Rous sarcoma virus (Yamamoto et al. *Cell* 22:787-797 (1980)), the herpes thymidine kinase promoter (Wagner et al., *Proc. Natl. Acad. Sci. USA* 78:1441-1445 (1981)), the regulatory sequences of the metallothionein gene (Brinster et al., *Nature* 296:39-42 (1982)); prokaryotic expression vectors such as the β-lactamase promoter (Jay et al., (1981) *Proc. Natl. Acad. Sci. USA* 78:5543) or the tac promoter (DeBoer et al., *Proc. Natl. Acad. Sci. USA* 80:21-25 (1983)); see also Gilbert and Villa-Komaroff "Useful Proteins from Recombinant Bacteria" Scientific American 242:74-94 (1980)); plant expression vectors containing the nopaline synthetase promoter (Herrera-Estrella et al., *Nature* 303:209-213 (1984)) or the cauliflower mosaic virus 35S RNA promoter (Gardner et al., *Nucleic Acids Res.* 9:2871 (1981)), and the promoter of the photosynthetic enzyme ribulose bisphosphate carboxylase (Herrera-Estrella et al., *Nature* 310:115-120 (1984)); promoter elements from yeast and other fungi such as the Gal4 promoter, the alcohol dehydrogenase promoter, the phosphoglycerol kinase promoter, the alkaline phosphatase promoter, and the following animal transcriptional control regions that exhibit tissue specificity and have been used in transgenic animals: elastase I gene control region which is active in pancreatic acinar cells (Swift et al., *Cell* 38:639-646 (1984); Ornitz et al., *Cold Spring Harbor Symp. Quant. Biol.* 50:399-409 (1986); MacDonald, *Hepatology* 7:425-515 (1987)); insulin gene control region which is active in pancreatic beta cells (Hanahan et al., *Nature* 315:115-122 (1985)), immunoglobulin gene control region which is active in lymphoid cells (Grosschedl et al., *Cell* 38:647-658 (1984); Adams et al., *Nature* 318:533-538 (1985); Alexander et al., *Mol. Cell. Biol.* 7:1436-1444 (1987)), mouse mammary tumor virus control region which is active in testicular, breast, lymphoid and mast cells (Leder et al., *Cell* 45:485-495 (1986)), albumin gene control region which is active in liver (Pinkert et al., *Genes and Devel.* 1:268-276 (1987)), alpha-fetoprotein gene control region which is active in liver (Krumlauf et al., *Mol. Cell. Biol.* 5:1639-1648 (1985); Hammer et al., *Science* 235:53-58 1987)), alpha-1 antitrypsin gene control region which is active in liver (Kelsey et al., *Genes and Devel.* 1:161-171 (1987)), beta globin gene control region which is active in myeloid cells (Magram et al., *Nature* 315:338-340 (1985); Kollias et al., *Cell* 46:89-94 (1986)), myelin basic protein gene control region which is active in oligodendrocyte cells of the brain (Readhead et al., *Cell* 48:703-712 (1987)), myosin light chain-2 gene control region which is active in skeletal muscle (Shani, *Nature* 314:283-286 (1985)), and gonadotrophic releasing hormone gene control region which is active in gonadotrophs of the hypothalamus (Mason et al., *Science* 234:1372-1378 (1986)).

In a specific embodiment, a vector is used that contains a promoter operably linked to nucleic acids encoding a desired protein, or a domain, fragment, derivative or homolog, thereof, one or more origins of replication, and optionally, one or more selectable markers (e.g., an antibiotic resistance gene). Exemplary plasmid vectors for transformation of *E. coli* cells, include, for example, the pQE expression vectors (available from Qiagen, Valencia, Calif.; see also literature published by Qiagen describing the system). pQE vectors have a phage T5 promoter (recognized by *E. coli* RNA polymerase) and a double lac operator repression module to provide tightly regulated, high-level expression of recombinant proteins in *E. coli*, a synthetic ribosomal binding site (RBS II) for efficient translation, a 6×His tag coding sequence, $t_0$ and T1 transcriptional terminators, ColE1 origin of replication, and a beta-lactamase gene for conferring ampicillin resistance. The pQE vectors enable placement of a 6×His tag at either the N- or C-terminus of the recombinant protein. Such plasmids include pQE 32, pQE 30, and pQE 31 which provide multiple cloning sites for all three reading frames and provide for the expression of N-terminally 6×His-tagged proteins. Other exemplary plasmid vectors for transformation of *E. coli* cells, include, for example, the pET expression vectors (see, U.S. Pat. No. 4,952,496; available from Novagen, Madison, Wis.; see, also literature published by Novagen describing the system). Such plasmids include pET 11a, which contains the T7lac promoter, T7 terminator, the inducible *E. coli* lac operator, and the lac repressor gene; pET 12a-c, which contains the T7 promoter, T7 terminator, and the *E. coli* ompT secretion signal; and pET 15b and pET19b (Novagen, Madison, Wis.), which contain a His-Tag™ leader sequence for use in purification with a His column and a thrombin cleavage site that permits cleavage following purification over the column, the T7-lac promoter region and the T7 terminator.

Exemplary of a vector for mammalian cell expression is the HZ24 expression vector. The HZ24 expression vector was derived from the pCI vector backbone (Promega). It contains DNA encoding the Beta-lactamase resistance gene (AmpR), an F1 origin of replication, a Cytomegalovirus immediate-early enhancer/promoter region (CMV), and an SV40 late polyadenylation signal (SV40). The expression vector also has an internal ribosome entry site (IRES) from the ECMV virus (Clontech) and the mouse dihydrofolate reductase (DHFR) gene.

2. Expression

Hyaluronan binding proteins and hyaluronan-degrading enzyme polypeptides, including soluble hyaluronidase polypeptides, can be produced by any method known to those of skill in the art including in vivo and in vitro methods. Desired proteins can be expressed in any organism suitable to produce the required amounts and forms of the proteins, such as for example, the amounts and forms needed for administration and treatment. Expression hosts include prokaryotic and eukaryotic organisms such as *E. coli*, yeast, plants, insect cells, mammalian cells, including human cell lines and transgenic animals. Expression hosts can differ in their protein production levels as well as the types of post-translational modifications that are present on the expressed proteins. The choice of expression host can be made based on these and other factors, such as regulatory and safety considerations, production costs and the need and methods for purification.

Many expression vectors are available and known to those of skill in the art and can be used for expression of proteins. The choice of expression vector will be influenced by the choice of host expression system. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vector.

Hyaluronan binding proteins and hyaluronan-degrading enzyme polypeptides, such as soluble hyaluronidase polypeptides, also can be utilized or expressed as protein fusions. For example, an enzyme fusion can be generated to add additional functionality to an enzyme. Examples of enzyme fusion proteins include, but are not limited to, fusions of a signal sequence, a tag such as for localization, e.g. a $his_6$ tag or a myc tag, or a tag for purification, for example, a GST fusion, and a sequence for directing protein secretion and/or membrane association.

a. Prokaryotic Cells

Prokaryotes, especially *E. coli*, provide a system for producing large amounts of proteins. Transformation of *E. coli* is a simple and rapid technique well known to those of skill in the art. Expression vectors for *E. coli* can contain inducible promoters, such promoters are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated λPL promoter.

Proteins, such as any provided herein, can be expressed in the cytoplasmic environment of *E. coli*. The cytoplasm is a reducing environment and for some molecules, this can result in the formation of insoluble inclusion bodies. Reducing agents such as dithiothreitol and β-mercaptoethanol and denaturants, such as guanidine-HCl and urea can be used to resolubilize the proteins. An alternative approach is the expression of proteins in the periplasmic space of bacteria which provides an oxidizing environment and chaperonin-like and disulfide isomerases and can lead to the production of soluble protein. Typically, a leader sequence is fused to the protein to be expressed which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility, typically temperatures between 25° C. and 37° C. are used. Typically, bacteria produce aglycosylated proteins. Thus, if proteins require glycosylation for function, glycosylation can be added in vitro after purification from host cells.

b. Yeast Cells

Yeasts such as *Saccharomyces cerevisae, Schizosaccharomyces pombe, Yarrowia lipolytica, Kluyveromyces lactis* and *Pichia pastoris* are well known yeast expression hosts that can be used for production of proteins, such as any described herein. Yeast can be transformed with episomal replicating vectors or by stable chromosomal integration by homologous recombination. Typically, inducible promoters are used to regulate gene expression. Examples of such promoters include GAL1, GAL7 and GAL5 and metallothionein promoters, such as CUP1, AOX1 or other *Pichia* or other yeast promoter. Expression vectors often include a selectable marker such as LEU2, TRP1, HIS3 and URA3 for selection and maintenance of the transformed DNA. Proteins expressed in yeast are often soluble. Co-expression with chaperonins such as Bip and protein disulfide isomerase can improve expression levels and solubility. Additionally, proteins expressed in yeast can be directed for secretion using secretion signal peptide fusions such as the yeast mating type alpha-factor secretion signal from *Saccharomyces* cerevisae and fusions with yeast cell surface proteins such as the Aga2p mating adhesion receptor or the *Arxula adeninivorans* glucoamylase. A protease cleavage site such as for the Kex-2 protease, can be engineered to remove the fused sequences from the expressed polypeptides as they exit the secretion pathway. Yeast also is capable of glycosylation at Asn-X-Ser/Thr motifs.

c. Insect Cells

Insect cells, particularly using baculovirus expression, are useful for expressing polypeptides including the hyaluronan binding proteins and hyaluronan-degrading enzyme polypeptides, such as soluble hyaluronidase polypeptides. Insect cells express high levels of protein and are capable of most of the post-translational modifications used by higher eukaryotes. Baculovirus have a restrictive host range which improves the safety and reduces regulatory concerns of eukaryotic expression. Typical expression vectors use a promoter for high level expression such as the polyhedrin promoter of baculovirus. Commonly used baculovirus systems include the baculoviruses such as *Autographa californica* nuclear polyhedrosis virus (AcNPV), and the *Bombyx mori* nuclear polyhedrosis virus (BmNPV) and an insect cell line such as Sf9 derived from *Spodoptera frugiperda, Pseudaletia unipuncta* (A7S) and *Danaus plexippus* (DpN1). For high-level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems.

An alternative expression system in insect cells is the use of stably transformed cells. Cell lines such as the Schneider 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Expression vectors are typically maintained by the use of selectable markers such as neomycin and hygromycin.

d. Mammalian Cells

Mammalian expression systems can be used to express proteins, including the hyaluronan binding proteins and hyaluronan-degrading enzyme polypeptides, such as soluble hyaluronidase polypeptides. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. IRES elements also can be added to permit bicistronic expression with another gene, such as a selectable marker. Such vectors often include transcriptional promoter-enhancers for high-level expression, for example the SV40 promoter-enhancer, the human cytomegalovirus (CMV) promoter and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha fetoprotein, alpha 1 antitrypsin, beta globin, myelin basic protein, myosin light chain 2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase (DHFR) and thymidine kinase. For example, expression can be performed in the presence of methotrexate to select for only those cells expressing the DHFR gene. Fusion with cell surface signaling molecules such as TCR-ζ and Fc$_\epsilon$RI-γ can direct expression of the proteins in an active state on the cell surface.

Many cell lines are available for mammalian expression including mouse, rat human, monkey, chicken and hamster cells. Exemplary cell lines include but are not limited to CHO, Balb/3T3, HeLa, MT2, mouse NS0 (nonsecreting) and other myeloma cell lines, hybridoma and heterohybridoma cell lines, lymphocytes, fibroblasts, Sp2/0, COS, NIH3T3, HEK293, 293S, 2B8, and HKB cells. Cell lines also are available adapted to serum-free media which facilitates purification of secreted proteins from the cell culture media. Examples include CHO—S cells (Invitrogen, Carlsbad, Calif., cat #11619-012) and the serum free EBNA-1 cell line (Pham et al., (2003) *Biotechnol. Bioeng.* 84:332-342). Cell lines also are available that are adapted to grow in special media optimized for maximal expression. For example, DG44 CHO cells are adapted to grow in suspension culture in a chemically defined, animal product-free medium.

e. Plants

Transgenic plant cells and plants can be used to express proteins such as any described herein. Expression constructs are typically transferred to plants using direct DNA transfer such as microprojectile bombardment and PEG-mediated transfer into protoplasts, and with *agrobacterium*-mediated transformation. Expression vectors can include promoter and enhancer sequences, transcriptional termination elements and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline synthetase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce hyaluronidase polypeptides. Because plants have different glycosylation patterns than mammalian cells, this can influence the choice of protein produced in these hosts.

3. Purification Techniques

Methods for purification of polypeptides, including hyaluronan binding proteins and hyaluronan-degrading enzyme polypeptides (e.g. soluble hyaluronidase polypeptides) or other proteins, from host cells will depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary, the proteins can be extracted and further purified using standard methods in the art.

Proteins can be purified using standard protein purification techniques known in the art including but not limited to, SDS-PAGE, size fraction and size exclusion chromatography, ammonium sulfate precipitation and ionic exchange chromatography, such as anion exchange. Affinity purification techniques also can be utilized to improve the efficiency and purity of the preparations. For example, antibodies, receptors and other molecules that bind to hyaluronan binding proteins or hyaluronidase enzymes can be used in affinity purification. Expression constructs also can be engineered to add an affinity tag to a protein such as a myc epitope, GST fusion or His$_6$ and affinity purified with myc antibody, glutathione resin and Ni-resin, respectively. Purity can be assessed by any method known in the art including gel electrophoresis and staining and spectrophotometric techniques. Purified rHuPH20 compositions, as provided herein, typically have a specific activity of at least 70,000 to 100,000 Units/mg, for example, about 120,000 Units/mg. The specific activity can vary upon modification, such as with a polymer.

4. PEGylation of Hyaluronan-Degrading Enzyme Polypeptides

Polyethylene glycol (PEG) has been widely used in biomaterials, biotechnology and medicine primarily because PEG is a biocompatible, nontoxic, water-soluble polymer that is typically nonimmunogenic (Zhao and Harris, *ACS*

*Symposium Series* 680: 458-72, 1997). In the area of drug delivery, PEG derivatives have been widely used in covalent attachment (i.e., "PEGylation") to proteins to reduce immunogenicity, proteolysis and kidney clearance and to enhance solubility (Zalipsky, Adv. Drug Del. Rev. 16:157-82, 1995). Similarly, PEG has been attached to low molecular weight, relatively hydrophobic drugs to enhance solubility, reduce toxicity and alter biodistribution. Typically, PEGylated drugs are injected as solutions.

A closely related application is synthesis of crosslinked degradable PEG networks or formulations for use in drug delivery since much of the same chemistry used in design of degradable, soluble drug carriers can also be used in design of degradable gels (Sawhney et al., *Macromolecules* 26: 581-87, 1993). It also is known that intermacromolecular complexes can be formed by mixing solutions of two complementary polymers. Such complexes are generally stabilized by electrostatic interactions (polyanion-polycation) and/or hydrogen bonds (polyacid-polybase) between the polymers involved, and/or by hydrophobic interactions between the polymers in an aqueous surrounding (Krupers et al., *Eur. Polym J.* 32:785-790, 1996). For example, mixing solutions of polyacrylic acid (PAAc) and polyethylene oxide (PEO) under the proper conditions results in the formation of complexes based mostly on hydrogen bonding. Dissociation of these complexes at physiologic conditions has been used for delivery of free drugs (i.e., non-PEGylated). In addition, complexes of complementary polymers have been formed from both homopolymers and copolymers.

Numerous reagents for PEGylation have been described in the art. Such reagents include, but are not limited to, N-hydroxysuccinimidyl (NHS) activated PEG, succinimidyl mPEG, mPEG$_2$-N-hydroxysuccinimide, mPEG succinimidyl alpha-methylbutanoate, mPEG succinimidyl propionate, mPEG succinimidyl butanoate, mPEG carboxymethyl 3-hydroxybutanoic acid succinimidyl ester, homobifunctional PEG-succinimidyl propionate, homobifunctional PEG propionaldehyde, homobifunctional PEG butyraldehyde, PEG maleimide, PEG hydrazide, p-nitrophenyl-carbonate PEG, mPEG-benzotriazole carbonate, propionaldehyde PEG, mPEG butryaldehyde, branched mPEG$_2$ butyraldehyde, mPEG acetyl, mPEG piperidone, mPEG methylketone, mPEG "linkerless" maleimide, mPEG vinyl sulfone, mPEG thiol, mPEG orthopyridylthioester, mPEG orthopyridyl disulfide, Fmoc-PEG-NHS, Boc-PEG-NHS, vinylsulfone PEG-NHS, acrylate PEG-NHS, fluorescein PEG-NHS, and biotin PEG-NHS (see e.g., Monfardini et al., *Bioconjugate Chem.* 6:62-69, 1995; Veronese et al., *J. Bioactive Compatible Polymers* 12:197-207, 1997; U.S. Pat. No. 5,672,662; U.S. Pat. No. 5,932,462; U.S. Pat. No. 6,495,659; U.S. Pat. No. 6,737,505; U.S. Pat. No. 4,002,531; U.S. Pat. No. 4,179,337; U.S. Pat. No. 5,122,614; U.S. Pat. No. 5,324,844; U.S. Pat. No. 5,446,090; U.S. Pat. No. 5,612,460; U.S. Pat. No. 5,643,575; U.S. Pat. No. 5,766,581; U.S. Pat. No. 5,795,569; U.S. Pat. No. 5,808,096; U.S. Pat. No. 5,900,461; U.S. Pat. No. 5,919,455; U.S. Pat. No. 5,985,263; U.S. Pat. No. 5,990,237; U.S. Pat. No. 6,113,906; U.S. Pat. No. 6,214,966; U.S. Pat. No. 6,258,351; U.S. Pat. No. 6,340,742; U.S. Pat. No. 6,413,507; U.S. Pat. No. 6,420,339; U.S. Pat. No. 6,437,025; U.S. Pat. No. 6,448,369; U.S. Pat. No. 6,461,802; U.S. Pat. No. 6,828,401; U.S. Pat. No. 6,858,736; U.S. 2001/0021763; U.S. 2001/0044526; U.S. 2001/0046481; U.S. 2002/0052430; U.S. 2002/0072573; U.S. 2002/0156047; U.S. 2003/0114647; U.S. 2003/0143596; U.S. 2003/0158333; U.S. 2003/0220447; U.S. 2004/0013637; US 2004/0235734; WO05000360; U.S. 2005/0114037; U.S. 2005/0171328; U.S. 2005/0209416; EP 1064951; EP 0822199; WO 01076640; WO 0002017; WO 0249673; WO 9428024; and WO 0187925).

In one example, the polyethylene glycol has a molecular weight ranging from about 3 kD to about 50 kD, and typically from about 5 kD to about 30 kD. Covalent attachment of the PEG to the drug (known as "PEGylation") can be accomplished by known chemical synthesis techniques. For example, the PEGylation of protein can be accomplished by reacting NHS-activated PEG with the protein under suitable reaction conditions.

While numerous reactions have been described for PEGylation, those that are most generally applicable confer directionality, utilize mild reaction conditions, and do not necessitate extensive downstream processing to remove toxic catalysts or bi-products. For instance, monomethoxy PEG (mPEG) has only one reactive terminal hydroxyl, and thus its use limits some of the heterogeneity of the resulting PEG-protein product mixture. Activation of the hydroxyl group at the end of the polymer opposite to the terminal methoxy group is generally necessary to accomplish efficient protein PEGylation, with the aim being to make the derivatised PEG more susceptible to nucleophilic attack. The attacking nucleophile is usually the epsilon-amino group of a lysyl residue, but other amines also can react (e.g. the N-terminal alpha-amine or the ring amines of histidine) if local conditions are favorable. A more directed attachment is possible in proteins containing a single lysine or cysteine. The latter residue can be targeted by PEG-maleimide for thiol-specific modification. Alternatively, PEG hydrazide can be reacted with a periodate oxidized hyaluronan-degrading enzyme and reduced in the presence of NaCNBH$_3$. More specifically, PEGylated CMP sugars can be reacted with a hyaluronan-degrading enzyme in the presence of appropriate glycosyltransferases. One technique is the "PEGylation" technique where a number of polymeric molecules are coupled to the polypeptide in question. When using this technique the immune system has difficulties in recognizing the epitopes on the polypeptide's surface responsible for the formation of antibodies, thereby reducing the immune response. For polypeptides introduced directly into the circulatory system of the human body to give a particular physiological effect (i.e. pharmaceuticals) the typical potential immune response is an IgG and/or IgM response, while polypeptides which are inhaled through the respiratory system (i.e. industrial polypeptide) potentially can cause an IgE response (i.e. allergic response). One of the theories explaining the reduced immune response is that the polymeric molecule(s) shield(s) epitope(s) on the surface of the polypeptide responsible for the immune response leading to antibody formation. Another theory or at least a partial factor is that the heavier the conjugate is, the more reduced immune response is obtained.

Typically, to make the PEGylated hyaluronan-degrading enzymes provided herein, including the PEGylated hyaluronidases, PEG moieties are conjugated, via covalent attachment, to the polypeptides. Techniques for PEGylation include, but are not limited to, specialized linkers and coupling chemistries (see e.g., Roberts, *Adv. Drug Deliv. Rev.* 54:459-476, 2002), attachment of multiple PEG moieties to a single conjugation site (such as via use of branched PEGs; see e.g., Guiotto et al., *Bioorg. Med. Chem. Lett.* 12:177-180, 2002), site-specific PEGylation and/or mono-PEGylation (see e.g., Chapman et al., *Nature Biotech.* 17:780-783, 1999), and site-directed enzymatic PEGylation (see e.g., Sato, *Adv. Drug Deliv. Rev.*, 54:487-504, 2002). Methods and techniques described in the art can produce proteins having 1, 2, 3, 4, 5, 6, 7, 8, 9, 10 or more than 10 PEG or PEG derivatives attached to a single protein molecule (see e.g., U.S. 2006/0104968).

As an exemplary illustrative method for making PEGylated hyaluronan-degrading enzymes, such as PEGylated hyaluronidases, PEG aldehydes, succinimides and carbonates have each been applied to conjugate PEG moieties, typically succinimidyl PEGs, to rHuPH20. For example, rHuPH20 has been conjugated with exemplary succinimidyl monoPEG (mPEG) reagents including mPEG-Succinimidyl Propionates (mPEG-SPA), mPEG-Succinimidyl Butanoates (mPEG-SBA), and (for attaching "branched" PEGs) mPEG2-N-Hydroxylsuccinimide. These PEGylated succinimidyl esters contain different length carbon backbones between the PEG group and the activated cross-linker, and either a single or branched PEG group. These differences can be used, for example, to provide for different reaction kinetics and to potentially restrict sites available for PEG attachment to rHuPH20 during the conjugation process.

Succinimidyl PEGs (as above) comprising either linear or branched PEGs can be conjugated to rHuPH20. PEGs can used to generate rHuPH20s reproducibly containing molecules having, on the average, between about three to six or three to six PEG molecules per hyaluronidase. Such PEGylated rHuPH20 compositions can be readily purified to yield compositions having specific activities of approximately 25,000 or 30,000 Unit/mg protein hyaluronidase activity, and being substantially free of non-PEGylated rHuPH20 (less than 5% non-PEGylated).

Using various PEG reagents, exemplary versions of hyaluronan-degrading enzymes, in particular soluble human recombinant hyaluronidases (e.g. rHuPH20), can be prepared, for example, using mPEG-SBA (30 kD), mPEG-SMB (30 kD), and branched versions based on mPEG2-NHS (40 kD) and mPEG2-NHS (60 kD). PEGylated versions of rHuPH20 have been generated using NHS chemistries, as well as carbonates, and aldehydes, using each of the following reagents: mPEG2-NHS-40K branched, mPEG-NHS-10K branched, mPEG-NHS-20K branched, mPEG2-NHS-60K branched; mPEG-SBA-5K, mPEG-SBA-20K, mPEG-SBA-30K; mPEG-SMB-20K, mPEG-SMB-30K; mPEG-butyraldehyde; mPEG-SPA-20K, mPEG-SPA-30K; and PEG-NHS-5K-biotin. PEGylated hyaluronidases have also been prepared using PEG reagents available from Dowpharma, a division of Dow Chemical Corporation; including hyaluronidases PEGylated with Dowpharma's p-nitrophenyl-carbonate PEG (30 kDa) and with propionaldehyde PEG (30 kDa).

In one example, the PEGylation includes conjugation of mPEG-SBA, for example, mPEG-SBA-30K (having a molecular weight of about 30 kDa) or another succinimidyl esters of PEG butanoic acid derivative, to a soluble hyaluronidase. Succinimidyl esters of PEG butanoic acid derivatives, such as mPEG-SBA-30K readily couple to amino groups of proteins. For example, covalent conjugation of m-PEG-SBA-30K and rHuPH20 (which is approximately 60 KDa in size) provides stable amide bonds between rHuPH20 and mPEG, as shown in Scheme 1, below.

Scheme 1

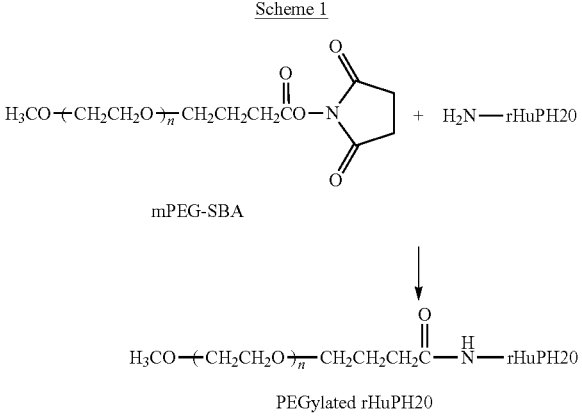

Typically, the mPEG-SBA-30K or other PEG is added to the hyaluronan-degrading enzyme, in some instances a hyaluronidase, at a PEG:polypeptide molar ratio of 10:1 in a suitable buffer, e.g. 130 mM NaCl/10 mM HEPES at pH 6.8 or 70 mM phosphate buffer, pH 7, followed by sterilization, e.g. sterile filtration, and continued conjugation, for example, with stirring, overnight at 4° C. in a cold room. In one example, the conjugated PEG-hyaluronan-degrading enzyme is concentrated and buffer-exchanged.

Other methods of coupling succinimidyl esters of PEG butanoic acid derivatives, such as mPEG-SBA-30K are known in the art (see e.g., U.S. Pat. No. 5,672,662; U.S. Pat. No. 6,737,505; and U.S. 2004/0235734). For example, a polypeptide, such as a hyaluronan-degrading enzyme (e.g. a hyaluronidase), can be coupled to an NHS activated PEG derivative by reaction in a borate buffer (0.1 M, pH 8.0) for one hour at 4° C. The resulting PEGylated protein can be purified by ultrafiltration. Alternatively, PEGylation of a bovine alkaline phosphatase can be accomplished by mixing the phosphatase with mPEG-SBA in a buffer containing 0.2 M sodium phosphate and 0.5 M NaCl (pH 7.5) at 4° C. for 30 minutes. Unreacted PEG can be removed by ultrafiltration. Another method reacts polypeptide with mPEG-SBA in deionized water to which triethylamine is added to raise the pH to 7.2-9. The resulting mixture is stirred at room temperature for several hours to complete the PEGylation.

Methods for PEGylation of hyaluronan-degrading polypeptides, including, for example, animal-derived hyaluronidases and bacterial hyaluronan-degrading enzymes, are known to one of skill in the art. See, for example, European Patent No. EP 0400472, which describes the PEGylation of bovine testes hyaluorindase and chondroitin ABC lyase. Also, U.S. Publication No. 2006014968 describes PEGylation of a human hyaluronidase derived from human PH20. For example, the PEGylated hyaluronan-degrading enzyme generally contains at least 3 PEG moieties per molecule. For example, the hyaluronan-degrading enzyme can have a PEG to protein molar ratio between 5:1 and 9:1, for example, 7:1.

G. METHODS OF ASSESSING ACTIVITY AND MONITORING EFFECTS OF ANTI-HYALURONAN AGENTS

Anti-hyaluronan agents, for example hyaluronan-degrading enzymes, such as a hyaluronidase or modified hyaluronidase (e.g. PH20 or PEGPH20) act as therapeutic agents either alone, or in combination with secondary agents such as chemotherapeutic drugs, for the treatment of hyaluronan-associated diseases and conditions, in particular cancers (see for example, US 2010/0003238 and WO09/128917). In addition, as described elsewhere herein, therapy with an anti-hyaluronan agent, for example a hyaluronan-degrading enzyme, can be accompanied by treatment with a corticosteroid to minimize the systemic, for example musculoskeletal, side effects of the PEGylated hyaluronidase. The HABP companion diagnostics, such as TSG-6-LM or TSG-6-LM:Fc or variants thereof, provided herein can be used in conjunction with an anti-hyaluronan agent therapy, for example a hyaluronan-degrading enzyme therapy, used for the treatment of hyaluronan-associated diseases or disorders, such as cancer, in order to monitor responsiveness and efficacy of treatment with the agent (e.g. a hyaluronan-degrading enzyme). In addition, adjunct or supplementary methods also can be utilized to assess the effects of anti-hyaluronan agents (e.g. hyaluronan-degrading enzymes) in treatment alone or in combination with corticosteroids. It is within the level of one of skill in the art to assess amelioration of side effects by corticosteroids, as wells as efficacy, tolerability and pharmacokinetic studies of anti-hyaluronan agent therapy, including hyaluronan-degrading enzyme therapy. This section provides description of adjunct or supplementary methods that can be used to assess efficacy, responsiveness, tolerability and/or pharmacokinetics of a hyaluronan-degrading enzyme therapy.

1. Methods to Assess Side Effects

In vivo assays can be used to assess the efficacy of corticosteroids on the amelioration or elimination of the musculoskeletal side effects that can be caused by an anti-hyaluronan agents, for example a hyaluronan-degrading enzyme, such as a hyaluronidase or hyaluronidase modified to exhibit increased systemic half-life (e.g. PH20 or PEGPH20). Side effects that can be assessed include, for example, muscle and joint pain, stiffness of upper and lower extremities, cramping, myositis, muscle soreness and tenderness over the entire body, weakness, fatigue and/or a decrease in range of motion at knee and elbow joints. Assays to assess side effects can include animal models wherein the animal can be observed for reduced movement, behavior or posture changes, radiographic findings, histopathological changes and other notable clinical observations. Other assays can include clinical trials in human subjects wherein patients can be questioned regarding symptoms, assessed by physical examination, imaging (for example by MRI or PET) or by radiologic evaluation. Amelioration of a side effect caused by administration of an anti-hyaluronan agent (e.g. a hyaluronan-degrading enzyme agent) is observed when the side effect is ameliorated, eliminated, lessened or reduced in the presence of the corticosteroid compared to in its absence.

In such examples, the dose of anti-hyaluronan agent (e.g. a hyaluronan-degrading enzyme) and/or corticosteroid can be varied to identify the optimal or minimal dose required to achieve activity while ameliorating side effects. Such studies are within the level of one of skill in the art. Further, the dosage regime can be varied. For example, studies can be performed using a dosage schedule of hyaluronan-degrading enzyme monthly, biweekly, once a week, twice a week, three times a week, four times a week or more. Further, the corticosteroid can be administered prior to, concurrently and/or subsequent to administration of the anti-hyaluronan agent (e.g. a hyaluronan-degrading enzyme).

For example, in vivo animal models can be utilized to assess the ability of corticosteroids, such as dexamethasone, to ameliorate or eliminate the side effects associated with anti-hyaluronan agent (e.g. hyaluronan-degrading enzyme) administration. Animal models can include non-human primates such as cynomolgus monkeys or rhesus macaques, dogs, for example beagle dogs, or any other animal that exhibits adverse side effects in response to treatment with an anti-hyaluronan agent (e.g. a hyaluronan-degrading enzyme, such as a PEGylated hyaluronidase, for example PEGPH20) treatment. The animal models can be dosed with an anti-hyaluronan agent (e.g. a hyaluronan-degrading enzyme) in the presence or absence of corticosteroid and musculoskeletal effects observed or measured.

For example, animals such as cynomolgus monkeys, beagles or other similar animal model capable of observable or measurable musculoskeletal events can be treated with hyaluronan-degrading enzyme in the presence or absence of corticosteroid. In one example, a group of animals, for example cynomolgus monkeys or beagles, is administered with an anti-hyaluronan agent, such as a hyaluronan-degrading enzyme alone, for example a PEGylated hyaluronidase, such as by intravenous administration. For example, administration can be twice weekly. Treatment can continue until changes in limb joint range-of-motion are observed at the knee and elbow joints or stiffness or reduced mobility is observed. Then, another group of animals can be treated with the anti-hyaluronan agent (e.g. hyaluronan-degrading enzyme) and corticosteroid administered, such as by oral doses of dexamethasone or other corticosteroid, given on the same day as the anti-hyaluronan agent (e.g. hyaluronan-degrading enzyme) administration. The groups of animals can then be compared for example, via physical examination of joint range-of-motion or other reduced mobility, histopathology of the joints, palpation for stiffness, or imaging known to those of skill in the art, to assess the ability of the corticosteroid, such as dexamethasone, to ameliorate the anti-hyaluronan agent-mediated, such as hyaluronan-degrading enzyme-mediated, musculoskeletal side effects. Dose, dosing frequency, route of administration, and timing of dosing of corticosteroid, such as dexamethasone, can be varied to optimize the effectiveness of the corticosteroid.

In another example, the efficacy of corticosteroids such as dexamethasone on the amelioration or elimination of the adverse side effects associated with an anti-hyaluronan agent (e.g. a hyaluronan-degrading enzyme) administration can be assessed in human patients with solid tumors. For example human patients can be dosed to examine the ability of corticosteroid to ameliorate and/or eliminate anti-hyaluronan agent-mediated (e.g. hyaluronan-degrading enzyme-mediated) adverse events including, but not limited to any one or more of the following: muscle and joint pain/stiffness of upper and lower extremities, cramping, muscle, myositis muscle soreness and tenderness over the entire body, weakness and fatigue. Patients can be treated with an anti-hyaluronan agent (e.g. a hyaluronan-degrading enzyme) with or without co-treatment with a corticosteroid such as dexamethasone. During and after administration of an anti-hyaluronan agent (e.g. a hyaluronan-degrading enzyme), side effects of both treatment groups can be assessed. A physician can determine the severity of the symptoms by physical examination of the subject including for example, patient complaints, vital signs, changes in body weight, 12-lead ECG, echocardiogram, clinical chemistry, or imaging (MRI, PET or radiologic evaluation). The severity of symptoms can then be quantified using the NCI Common Terminology Criteria for Adverse Events (CTCAE) grading system. The CTCAE is a descriptive terminology utilized for Adverse Event (AE) reporting. A grading (severity) scale is provided for each AE term. The CTCAE displays Grades 1 through 5, with clinical descriptions for severity for each adverse event based on the following general guideline: Grade 1 (Mild AE); Grade 2 (Moderate AE); Grade 3 (Severe AE); Grade 4 (Life-threatening or disabling AE); and Grade 5 (Death related to AE). The ability of a corticosteroid to ameliorate adverse side effects associated with administration of an anti-hyaluronan agent (e.g. a hyaluronan-degrading enzyme) can be measured by the observation of a reduction in grading or severity on the CTCAE scale in one or more adverse side effects in subjects treated with the anti-hyaluornan agent (e.g. hyaluronan-degrading enzyme) and corticosteroid as compared to subjects treated with the same anti-hyaluronan agent (e.g. hyaluronan-degrading enzyme) alone, i.e., the severity of the side effects, is reduced from Grade 3 to Grade 1 or Grade 2.

In another example, human patients can be dosed to assess tolerability by escalating the dose of an anti-hyaluronan agent (e.g. a hyaluronan-degrading enzyme) and assessing the dose-limiting toxicity as measured by severity of side effects. In such an example, a maximum tolerated dose of an anti-hyaluronan agent (e.g. a hyaluronan-degrading enzyme) that can be tolerated in the presence of an ameliorating agent such as a corticosteroid can be determined. Treatment regimens can include a dose escalation wherein each patient receives a higher dose of hyaluronan-degrading enzyme at the same dose level of corticosteroid. Patients can be monitored for adverse events to determine the highest dose of hyaluronan-degrading enzyme that can be administered with a corticosteroid before side effects are no longer tolerated. Tolerability can be measured based on the severity of symptoms emerging during and after treatment. Doses of an anti-hyaluronan agent (e.g. a hyaluronan-degrading enzyme) can be escalated until adverse effects reach a predetermined level, for example, Grade 3. Dosing regimens can also include a tapering of the amount of corticosteroid administered to examine the continued need for corticosteroid and the possibility of acclimation to the anti-hyaluronan agent with respect to resulting side effects.

2. Evaluating Biomarkers Associated with Activity of an Anti-Hyaluronan Agent (e.g. a Hyaluronan-Degrading Enzyme Activity)

As described herein, the extent and level of HA phenotypes is a biomarker that is associated with and correlates to efficacy and activity of an anti-hyaluronan agent (e.g. hyaluronan-degrading enzyme). For example, for cancer patients with tumors such as advanced solid tumors, reduced tumor- and stroma-associated is a biomarker of activity of an administered hyaluronan-degrading enzyme. An HABP binding assay to detect HA present in tissue (e.g. tumor biopsy) or bodily fluids (e.g. plasma) as described elsewhere herein can be performed to evaluate and monitor the therapeutic effect of an anti-hyaluronan (e.g. hyaluronan-degrading enzyme).

In addition, assays can be performed separately or in conjugation with HABP assays described herein used to detect HA in tissue (e.g. tumor biopsy) or bodily fluids (e.g. plasma) to further assess the effects of an anti-hyaluronan agent (e.g. a hyaluronan-degrading enzyme) on hyaluronan inhibition or degradation activity. In particular, for treatment of a hyaluronan-associated disease or condition, such as cancer, clinical measures or biomarkers associated with activity of an anti-hyaluronan agent, for example a hyaluronan-degrading enzyme activity include, but are not limited to, reduced tumor metabolic activity, increased apparent diffusion and enhanced tumor perfusion and/or increase in HA catabolites. Additional assays to measure such biomarkers can include, but are not limited to, measurements of hyaluronan catabolites in blood or urine, measurements of hyaluronidase activity in plasma, or measurements of interstitial fluid pressure, vascular volume or water content in tumors. It is within the level of one skilled in the art to perform such assays.

These assays can be performed in animal models treated with a hyaluronan-degrading enzyme or in human patients. For example, animal models of hyaluronan-associated diseases, disorders or conditions can be utilized to assess the in vivo affect of administration of an anti-hyaluronan agent, for example a hyaluronan-degrading enzyme, such as a hyaluronidase or hyaluronidase modified to exhibit increased half-life (e.g. PH20 or PEGPH20). Another agent, such as a chemotherapeutic agent can also be included in the assessment of activity. Exemplary hyaluronan-associated diseases for which an appropriate animal model can be utilized include solid tumors, for example, late-stage cancers, a metastatic cancers, undifferentiated cancers, ovarian cancer, in situ carcinoma (ISC), squamous cell carcinoma (SCC), prostate cancer, pancreatic cancer, non-small cell lung cancer, breast cancer, colon cancer and other cancers. Also exemplary of hyaluronan-associated diseases and disorders are inflammatory diseases, disc pressure, cancer and edema, for example, edema caused by organ transplant, stroke, brain trauma or other injury.

Animal models can include, but are not limited to, mice, rats, rabbits, dogs, guinea pigs and non-human primate models, such as cynomolgus monkeys or rhesus macaques. In some examples, immunodeficient mice, such as nude mice or SCID mice, are transplanted with a tumor cell line from a hyaluronan-associated cancer to establish an animal model of that cancer. Exemplary cell lines from hyaluronan-associated cancers include, but are not limited to, PC3 prostate carcinoma cells, BxPC-3 pancreatic adenocarcinoma cells, MDA-MB-231 breast carcinoma cells, MCF-7 breast tumor cells, BT474 breast tumor cells, Tramp C2 prostate tumor cells and Mat-LyLu prostate cancer cells, and other cell lines described herein that are hyaluronan associated, e.g. contain elevated levels of hyaluronan. An anti-hyaluronan agent, such as a hyaluronan-degrading enzyme, can then be administered to the animal with or without a corticosteroid such as dexamethasone, to assess the effects of the corticosteroid on anti-hyaluronan activity by measuring, for example, hyaluronan levels or content. Hyaluronan content can be measured by staining tumor tissue samples for hyaluronan or by measuring soluble hyaluronan levels in plasma. Other measurements of anti-hyaluronan activity include the assessment of tumor volume, formation or size of halos, interstitial fluid pressure, water content and/or vascular volume.

In other examples, dogs such as beagle dogs, can be treated with an anti-hyaluronan agent in the presence or absence of a corticosteroid, such as dexamethasone. Tissues such as skin or skeletal muscle tissue are biopsied and stained for hyaluronan and evaluated visually. Tissues from animals treated with an anti-hyaluronan agent alone are then compared to tissues from aminals treated with the anti-hyaluronan agent and corticosteroid to measure the effect of the corticosteroid on anti-hyaluronan activity.

Assays for activity of an anti-hyaluronan agent, such as a hyaluronan-degrading enzyme activity, also can be performed in human subjects. For example, assays to measure a biomarker associated with an anti-hyaluronan agent (e.g. a hyaluronan-degrading enzyme) activity can be performed on human subjects known or suspected of having a hyaluronan-associated disease or condition (e.g. cancer) and that have been treated with a hyaluronan-degrading enzyme (e.g. PEGPH20).

a. Assays to Assess the Activity of a Hyaluronan Degrading Enzyme

The activity of a hyaluronan degrading enzyme can be assessed using methods well known in the art. For example, the USP XXII assay for hyaluronidase determines activity indirectly by measuring the amount of undegraded hyaluronic acid, or hyaluronan, (HA) substrate remaining after the enzyme is allowed to react with the HA for 30 min at 37° C. (USP XXII-NF XVII (1990) 644-645 United States Pharmacopeia Convention, Inc, Rockville, Md.). A Hyaluronidase Reference Standard (USP) or National Formulary (NF) Standard Hyaluronidase solution can be used in an assay to ascertain the activity, in units, of any hyaluronidase. In one example, activity is measured using a microturbidity assay. This is based on the formation of an insoluble precipitate when hyaluronic acid binds with serum albumin. The activity is measured by incubating hyaluronidase or a sample containing hyaluronidase, for example blood or plasma, with sodium hyaluronate (hyaluronic acid) for a set period of time (e.g. 10 minutes) and then precipitating the undigested sodium hyaluronate with the addition of acidified serum albumin. The turbidity of the resulting sample is measured at 640 nm after an additional development period. The decrease in turbidity resulting from hyaluronidase activity on the sodium hyaluronate substrate is a measure of hyaluronidase enzymatic activity.

In another example, hyaluronidase activity is measured using a microtiter assay in which residual biotinylated hyaluronic acid is measured following incubation with hyaluronidase or a sample containing hyaluronidase, for example, blood or plasma (see e.g. Frost and Stem (1997) Anal. Biochem. 251:263-269, U.S. Patent Publication No. 20050260186). The free carboxyl groups on the glucuronic acid residues of hyaluronic acid are biotinylated, and the biotinylated hyaluronic acid substrate is covalently coupled to a microtiter plate. Following incubation with hyaluronidase, the residual biotinylated hyaluronic acid substrate is detected using an avidin-peroxidase reaction, and compared to that obtained following reaction with hyaluronidase standards of known activity. Other assays to measure hyaluronidase activity also are known in the art and can be used in the methods herein (see e.g. Delpech et al., (1995) Anal. Biochem. 229:35-41; Takahashi et al., (2003) Anal. Biochem. 322:257-263).

The ability of an active hyaluronan degrading enzyme, such as a modified soluble hyaluronidase (eg PEGylated PH20) to act as a spreading or diffusing agent, e.g. for chemotherapeutics, also can be assessed. For example, trypan blue dye can be injected, such as subcutaneously or intradermally, with or without a hyaluronan degrading enzyme into the lateral skin on each side of nude mice. The dye area is then measured, such as with a microcaliper, to determine the ability of the hyaluronan degrading enzyme to act as a spreading agent (see e.g. U.S. Published Patent No. 20060104968).

b. Measurement of HA Catabolites

In another example, blood and urine can be collected at different time points throughout patient treatment and assayed for catabolites of hyaluronan. The presence of catabolites is indicative of the degradation of hyaluronan and is thus a measure of the activity of hyaluronidase. Plasma enzyme also can be assessed and measured over time following administration. For example, HA catabolites, which are HA-disaccharide breakdown products, can be assessed using high-performance liquid chromatography (HPLC) to separate and measure saccharide peak areas. Example 15 exemplifies this assay.

c. Tumor Metabolic Activity

A reduction in tumor metabolic activity is associated with anti-hyaluronan agent (e.g. hyaluronan-degrading enzyme) activity. Tumor metabolic activity can be assessed using standard procedures known in the art. For example, [18F]-fluorodeoxyglucose positron emission tomography (FDG-PET) can be used. PET is a non-invasive diagnostic that provides images and quantitative parameters of perfusion, cell viability, proliferation and/or metabolic activity of tissues. The images result from the use of different biological substances (e.g. sugars, amino acids, metabolic precursors, hormones) labelled with positron emitting radioisotopes. For example, FDG is an analogue of glucose and is taken up by living cells via the first stages of normal glucose pathway. In cancers, increased glycolytic activity exists resulting in trapping of FDG in the cancer cell. A decrease in FDG trapping correlates with a decreased tumor metabolic activity and anti-tumorigenic activity. Guidelines for PET imaging are known to one of skill in the art and should be followed by any treating physician or technician.

d. Increased Apparent Diffusion and Enhanced Tumor Perfusion

Additional methods of assessing anti-hyaluronan agent (e.g. hyaluronan-degrading enzyme) activity include assays that assess the diffusion of water in tissues. As discussed elsewhere herein, tissues that accumulate hyaluronan generally have a higher interstitial fluid pressure than normal tissue due to the concomitant accumulation of water. Thus, tissues that accumulate HA, such as tumors, have high interstitial fluid pressure, which can be measured by various methods known in the art. For example, diffusion MRI, such as ADC MRI or DCE MRI, can be used. Diffusion of water can be assessed by these procedures, and is directly correlated to presence of hyaluronan-rich tissues, such as solid tumors (see e.g. Chenevert et al. (1997) Clinical Cancer Research, 3:1457-1466). For example, tumors that accumulate hyaluronan have a distinguishable increase in ADC MRI or DCE MRI because of increased perfusion. Such assays can be performed in the presence and absence of a hyaluronan-degrading enzyme, and results compared. Methods of measuring diffusion are a useful measure of assessing cellular changes following such therapies.

3. Tumor Size and Volume

Activity of an anti-hyaluronan agent (e.g. hyaluronan-degrading enzymes) is associated with reductions in tumor size and/or volume. Tumor size and volume can be monitored based on techniques known to one of skill in the art. For example, tumor size and volume can be monitored by radiography, ultrasound imaging, necropsy, by use of calipers, by microCT or by $^{18}$F-FDG-PET. Tumor size also can be assessed visually. In particular examples, tumor size (diameter) is measured directly using calipers.

In other examples, tumor volume can be measured using an average of measurements of tumor diameter (D) obtained by caliper or ultrasound assessments. For example, tumor volume can be determined using VisualSonics Vevo 770 high-resolution ultrasound or other similar ultrasound. The volume can be determined from the formula $V=D^3 \times \pi/6$ (for diameter measured using calipers) or $V=D^2 \times d \times \pi/6$ (for diameter measured using ultrasound where d is the depth or thickness). For example, caliper measurements can be made of the tumor length (l) and width (w) and tumor volume calculated as length×width$^2$×0.52. In another example, microCT scans can be used to measure tumor volume (see e.g. Huang et al. (2009) *PNAS*, 106:3426-3430). As an example, mice can be injected with Optiray Pharmacy ioversol injection 74% contrast medium (e.g. 741 mg of ioversol/mL), mice anesthetized, and CT scanning done using a MicroCat 1A scanner or other similar scanner (e.g. IMTek) (40 kV, 600 µA, 196 rotation steps, total angle or rotation=196). The images can be reconstructed using software (e.g. RVA3 software program; ImTek). Tumor volumes can be determined by using available software (e.g. Amira 3.1 software; Mercury Computer Systems). Tumor volume or size also can be determined based on size or weight of a tumor.

The percent of tumor growth inhibition can be calculated based on the volume using the equation: % TGI=$[1-(T_n-T_0)\div(C_n-C_0)]\times100\%$, where "$T_n$" is the average tumor volume for the treatment group at day "n" after the final dose of hyaluronan-degrading enzyme; "$T_0$" is the average tumor volume in that treatment group at day 0, before treatment; "$C_n$" is the average tumor volume for the corresponding control group at day "n"; and "$C_0$" is the average tumor volume in the control group at day 0, before treatment. Statistical analysis of tumor volumes can be determined.

4. Pharmacokinetic and Pharmacodynamic Assays

Pharmacokinetic or pharmacodynamic studies can be performed using animal models or can be performed during studies with patients to assess the pharmacokinetic properties of an anti-hyaluronan agent, for example a hyaluronan degrading enzyme, such as a hyaluronidase or modified hyaluronidase (e.g. PEGPH20). Animal models include, but are not limited to, mice, rats, rabbits, dogs, guinea pigs and non-human primate models, such as cynomolgus monkeys or rhesus macaques. In some instances, pharmacokinetic or pharmacodynamic studies are performed using healthy animals. In other examples, the studies are performed using animal models of a disease for which therapy with hyaluronan is considered, such as animal models of any hyaluronan-associated disease or disorder, for example a tumor model.

The pharmacokinetic properties of an anti-hyaluronan agent (e.g. a hyaluronan-degrading enzyme, such as a modified hyaluronidase) can be assessed by measuring such parameters as the maximum (peak) concentration ($C_{max}$), the peak time (i.e. when maximum concentration occurs; $T_{max}$), the minimum concentration (i.e. the minimum concentration between doses; $C_{min}$), the elimination half-life ($T_{1/2}$) and area under the curve (i.e. the area under the curve generated by plotting time versus concentration; AUC), following administration. The absolute bioavailability of the agent or enzyme (e.g. a hyaluronidase) can be determined by comparing the area under the curve following subcutaneous delivery ($AUC_{sc}$) with the AUC following intravenous delivery ($AUC_{iv}$). Absolute bioavailability (F), can be calculated using the formula: F=$([AUC]_{sc}\times dose_{sc})/([AUC]_{iv}\times dose_{iv})$. A range of doses and different dosing frequency of dosing can be administered in the pharmacokinetic studies to assess the effect of increasing or decreasing concentrations of an anti-hyaluronan agent, for example a hyaluronan-degrading enzyme, such as a hyaluronidase or modified hyaluronidase (e.g. PEGylated PH20) in the dose.

H. KITS AND ARTICLES OF MANUFACTURE

Provided herein are kits for use in selecting patients for treatment with an anti-hyaluronan agent (e.g. a hyaluronan degrading enzyme), for predicting the efficacy of treatment with an anti-hyaluronan agent (e.g. hyaluronan degrading enzyme), for determining the prognosis of a patient with an HA-associated diseases, or for monitoring the efficacy of treatment with an anti-hyaluronan agent (e.g. a hyaluronan degrading enzyme) for the treatment of HA-associated diseases, in particular cancer. The kits provided herein contain an HABP reagent provided herein for the detection and quantitation of hyaluronan in a sample and optionally, reagents for performing the methods. For example, kits can additionally contain reagents for collection of tissues, preparation and processing of tissues, and reagents for quantitating the amount of HA in a sample, such as, but not limited to, detection reagents, such as antibodies, buffers, substrates for enzymatic staining, chromogens or other materials, such as slides, containers, microtiter plates, and optionally, instructions for performing the methods. Those of skill in the art will recognize many other possible containers and plates and reagents that can be used for contacting the various materials. Kits also can contain control samples representing tissues with different levels of HA or reference samples stained for HA content for comparison and classification of the test samples. The HABP diagnostic provided can be provided in a lyophilized or other stable formulation of the diagnostic agent. In some examples, the kit includes a device, such as an automated cellular imaging system (ACIS) fluorometer, luminometer, or spectrophotometer for assay detection.

Also provided are combinations of an HABP reagent provided herein, including the improved HABP reagents provided, and a hyaluronan degrading enzyme. As described herein, HABPs can be employed as companion diagnostic agents for treatment with a hyaluronan degrading enzyme. Such combinations optionally can be packaged as kits for the for use in selecting patients for treatment with an anti-hyaluronan agent (e.g. a hyaluronan degrading enzyme) and treating such patients with the anti-hyaluronan agent (e.g. a hyaluronan degrading enzyme), for predicting the efficacy of treatment with an anti-hyaluronan agent (e.g. a hyaluronan degrading enzyme) in a patient and treating such patients with the anti-hyaluronan agent (e.g. hyaluronan degrading enzyme), for determining the prognosis of a patient with an HA-associated diseases and treating such patients with the anti-hyaluronan agent (e.g. hyaluronan degrading enzyme), or for monitoring the efficacy of treatment of a patient with an anti-hyaluronan-degrading enzyme (e.g. a hyaluronan degrading enzyme) for the treatment of HA-associated diseases, in particular cancer, and treating such patients with the anti-hyaluronan agent (e.g. hyaluronan degrading enzyme) based on efficacy of treatment. Combinations, which can be packaged as kits, can include, one or more additional agents for therapy, such as an anti-cancer agent or for the treatment or a side effect of therapy, including a corticosteroid for the treatment of musculoskeletal sides effects associated with treatment with an anti-hyaluronan agent (e.g. hyaluronan degrading enzyme). The kits can include packing materials for the packaging of the anti-hyaluronan agent (e.g. hyauronan degrading enzyme) or the one or more additional therapeutic agents. For example, the kits can contain containers including single chamber and dual chamber containers. The containers include, but are not limited to, tubes, bottles and syringes. The containers can further include materials for administration, such as a needle for subcutaneous administration. The anti-hyaluronan agent (e.g. a hyauronan degrading enzyme) or the one or more additional therapeutic agents can be provided together or separately. The kit can, optionally, include instructions for administration including dosages, dosing regimens and instructions for modes of administration.

Kits provided herein also can include reagents for detecting the expression of one or more additional proteins or encoding RNAs in the sample, such as, for example, one or more additional cancer markers, such as, for example, but not limited to, carcinoembryonic antigen (CEA), Alpha-Fetoprotein (AFP), CA125, CA19-9, prostate specific antigen (PSA), human chorionic gonadotropin (HCG), HER2/neu antigen, CA27.29, CYFRA 21-2, LASA-P, CA15-3, TPA, S-100 and CA-125.

I. EXAMPLES

The following examples are included for illustrative purposes only and are not intended to limit the scope of the invention.

Example 1 rHuPH20 Expressing Cell Lines

A. Generation of an Initial Soluble rHuPH20-Expressing Cell Line

Chinese Hamster Ovary (CHO) cells were transfected with the HZ24 plasmid (set forth in SEQ ID NO:52). The HZ24 plasmid vector for expression of soluble rHuPH20 contains a pCI vector backbone (Promega), DNA encoding amino acids 1-482 of human PH20 hyaluronidase (SEQ ID NO:49), an internal ribosomal entry site (IRES) from the ECMV virus (Clontech), and the mouse dihydrofolate reductase (DHFR) gene. The pCI vector backbone also includes DNA encoding the Beta-lactamase resistance gene (AmpR), an f1 origin of replication, a Cytomegalovirus immediate-early enhancer/promoter region (CMV), a chimeric intron, and an SV40 late polyadenylation signal (SV40). The DNA encoding the soluble rHuPH20 construct contains an NheI site and a Kozak consensus sequence prior to the DNA encoding the methionine at amino acid position 1 of the native 35 amino acid signal sequence of human PH20, and a stop codon following the DNA encoding the tyrosine corresponding to amino acid position 482 of the human PH20 hyaluronidase set forth in SEQ ID NO:1), followed by a BamHI restriction site. The construct pC1-PH20-IRES-DHFR-SV40pa (HZ24), therefore, results in a single mRNA species driven by the CMV promoter that encodes amino acids 1-482 of human PH20 (set forth in SEQ ID NO:3 and amino acids 1-186 of mouse dihydrofolate reductase (set forth in SEQ ID NO:53 separated by the internal ribosomal entry site (IRES).

Non-transfected CHO cells growing in GIBCO Modified CD-CHO media for DHFR(−) cells, supplemented with 4 mM Glutamine and 18 ml/L Pluronic F68/L (Gibco), were seeded at $0.5 \times 10^6$ cells/ml in a shaker flask in preparation for transfection. Cells were grown at 37° C. in 5% $CO_2$ in a humidified incubator, shaking at 120 rpm. Exponentially growing non-transfected CHO cells were tested for viability prior to transfection.

Sixty million viable cells of the non-transfected CHO cell culture were pelleted and resuspended to a density of $2 \times 10^7$ cells in 0.7 mL of 2× transfection buffer (2×HeBS: 40 mM Hepes, pH 7.0, 274 mM NaCl, 10 mM KCl, 1.4 mM $Na_2HPO_4$, 12 mM dextrose). To each aliquot of resuspended cells, 0.09 mL (250 μg) of the linear HZ24 plasmid (linearized by overnight digestion with Cla I (New England Biolabs) was added, and the cell/DNA solutions were transferred into 0.4 cm gap BTX (Gentronics) electroporation cuvettes at room temperature. A negative control electroporation was performed with no plasmid DNA mixed with the cells. The cell/plasmid mixes were electroporated with a capacitor discharge of 330 V and 960 μF or at 350 V and 960 μF.

The cells were removed from the cuvettes after electroporation and transferred into 5 mL of Modified CD-CHO media for DHFR(−) cells, supplemented with 4 mM Glutamine and 18 ml/L Pluronic F68/L (Gibco), and allowed to grow in a well of a 6-well tissue culture plate without selection for 2 days at 37° C. in 5% $CO_2$ in a humidified incubator.

Two days post-electroporation, 0.5 mL of tissue culture media was removed from each well and tested for the presence of hyaluronidase activity using the microturbidity assay described in Example 3. Cells expressing the highest levels of hyaluronidase activity were collected from the tissue culture well, counted and diluted to $1 \times 10^4$ to $2 \times 10^4$ viable cells per mL. A 0.1 mL aliquot of the cell suspension was transferred to each well of five, 96 well round bottom tissue culture plates. One hundred microliters of CD-CHO media (GIBCO) containing 4 mM GlutaMAX™-1 supplement (GIBCO™, Invitrogen Corporation) and without hypoxanthine and thymidine supplements were added to the wells containing cells (final volume 0.2 mL).

Ten clones were identified from the 5 plates grown without methotrexate. Six of these HZ24 clones were expanded in culture and transferred into shaker flasks as single cell suspensions. Clones 3D3, 3E5, 2G8, 2D9, 1E11, and 4D10 were plated into 96-well round bottom tissue culture plates using a two-dimensional infinite dilution strategy in which cells were diluted 1:2 down the plate, and 1:3 across the plate, starting at 5000 cells in the top left hand well. Diluted clones were grown in a background of 500 non-transfected DG44 CHO cells per well, to provide necessary growth factors for the initial days in culture. Ten plates were made per subclone, with 5 plates containing 50 nM methotrexate and 5 plates without methotrexate.

Clone 3D3 produced 24 visual subclones (13 from the no methotrexate treatment, and 11 from the 50 nM methotrexate treatment). Significant hyaluronidase activity was measured in the supernatants from 8 of the 24 subclones (>50 Units/mL), and these 8 subclones were expanded into T-25 tissue culture flasks. Clones isolated from the methotrexate treatment protocol were expanded in the presence of 50 nM methotrexate. Clone 3D35M was further expanded in 500 nM methotrexate in shaker flasks and gave rise to clones producing in excess of 1,000 Units/ml hyaluronidase activity (clone 3D35M; or Gen1 3D35M). A master cell bank (MCB) of the 3D35M cells was then prepared.

B. Generation of a Second Generation Cell Line Expressing Soluble rHuPH20

The Gen1 3D35M cell line described in Example 1A was adapted to higher methotrexate levels to produce generation 2 (Gen2) clones. 3D35M cells were seeded from established methotrexate-containing cultures into CD CHO medium containing 4 mM GlutaMAX-1™ and 1.0 μM methotrexate. The cells were adapted to a higher methotrexate level by growing and passaging them 9 times over a period of 46 days in a 37° C., 7% $CO_2$ humidified incubator. The amplified population of cells was cloned out by limiting dilution in 96-well tissue culture plates containing medium with 2.0 μM methotrexate. After approximately 4 weeks, clones were identified and clone 3E10B was selected for expansion. 3E10B cells were grown in CD CHO medium containing 4 mM GlutaMAX-1™ and 2.0 μM methotrexate for 20 passages. A master cell bank (MCB) of the 3E10B cell line was created and frozen and used for subsequent studies.

Amplification of the cell line continued by culturing 3E10B cells in CD CHO medium containing 4 mM GlutaMAX-1™ and 4.0 μM methotrexate. After the $12^{th}$ passage, cells were frozen in vials as a research cell bank (RCB). One vial of the RCB was thawed and cultured in medium containing 8.0 μM methotrexate. After 5 days, the methotrexate concentration in the medium was increased to 16.0 μM, then 20.0 μM 18 days later. Cells from the $8^{th}$ passage in medium containing 20.0 μM methotrexate were cloned out by limiting dilution in 96-well tissue culture plates containing CD CHO medium containing 4 mM GlutaMAX-1™ and 20.0 μM methotrexate. Clones were identified 5-6 weeks later and clone 2B2 was selected for expansion in medium containing 20.0 μM methotrexate. After the 11th passage, 2B2 cells were frozen in vials as a research cell bank (RCB).

The resultant 2B2 cells are dihydrofolate reductase deficient (dhfr−) DG44 CHO cells that express soluble recombinant human PH20 (rHuPH20). The soluble PH20 is present in 2B2 cells at a copy number of approximately 206 copies/cell. Southern blot analysis of Spe I-, Xba I- and BamH I/Hind III-digested genomic 2B2 cell DNA using a rHuPH20-specific probe revealed the following restriction digest profile: one major hybridizing band of ~7.7 kb and four minor hybridizing bands (~13.9, ~6.6, ~5.7 and ~4.6 kb) with DNA digested with Spe I; one major hybridizing band of ~5.0 kb and two minor hybridizing bands (~13.9 and ~6.5 kb) with DNA digested with Xba I; and one single hybridizing band of ~1.4 kb observed using 2B2 DNA digested with BamH I/Hind III. Sequence analysis of the mRNA transcript indicated that the derived cDNA (SEQ ID NO:56) was identical to the reference sequence (SEQ ID NO:49) except for one base pair difference at position 1131, which was observed to be a thymidine (T) instead of the expected cytosine (C). This is a silent mutation, with no effect on the amino acid sequence.

Example 2

Production and Purification of rHuPH20

A. Production of Gen2 Soluble rHuPH20 in 300 L Bioreactor Cell Culture

A vial of HZ24-2B2 cells (Example 1B) was thawed and expanded from shaker flasks through 36 L spinner flasks in CD-CHO media (Invitrogen, Carlsbad, Calif.) supplemented with 20 μM methotrexate and GlutaMAX-1™ (Invitrogen). Briefly, a vial of cells was thawed in a 37° C. water bath, media was added and the cells were centrifuged. The cells were re-suspended in a 125 mL shake flask with 20 mL of fresh media and placed in a 37° C., 7% $CO_2$ incubator. The cells were expanded up to 40 mL in the 125 mL shake flask. When the cell density reached greater than $1.5 \times 10^6$ cells/mL, the culture was expanded into a 125 mL spinner flask in a 100 mL culture volume. The flask was incubated at 37° C., 7% $CO_2$. When the cell density reached greater than $1.5 \times 10^6$ cells/mL, the culture was expanded into a 250 mL spinner flask in 200 mL culture volume, and the flask was incubated at 37° C., 7% $CO_2$. When the cell density reached greater than $1.5 \times 10^6$ cells/mL, the culture was expanded into a 1 L spinner flask in 800 mL culture volume and incubated at 37° C., 7% $CO_2$. When the cell density reached greater than $1.5 \times 10^6$ cells/mL the culture was expanded into a 6 L spinner flask in 5000 mL culture volume and incubated at 37° C., 7% $CO_2$. When the cell density reached greater than $1.5 \times 10^6$ cells/mL the culture was expanded into a 36 L spinner flask in 32 L culture volume and incubated at 37° C., 7% $CO_2$.

A 400 L reactor was sterilized and 230 mL of CD-CHO media was added. Before use, the reactor was checked for contamination. Approximately 30 L cells were transferred from the 36 L spinner flasks to the 400 L bioreactor (Braun) at an inoculation density of $4.0 \times 10^5$ viable cells per ml and a total volume of 260 L. Parameters were temperature set point, 37° C.; Impeller Speed 40-55 RPM; Vessel Pressure: 3 psi; Air Sparge 0.5-1.5 L/Min.; Air Overlay: 3 L/min. The reactor was sampled daily for cell counts, pH verification, media analysis, protein production and retention. Also, during the run nutrient feeds were added. At 120 hrs (day 5), 10.4 L of Feed #1 Medium (4×CD-CHO+33 g/L Glucose+160 mL/L Glutamax-1™+83 mL/L Yeastolate+33 mg/L rHuInsulin) was added. At 168 hours (day 7), 10.8 L of Feed #2 (2×CD-CHO+33 g/L Glucose+80 mL/L Glutamax-1™+167 mL/L Yeastolate+0.92 g/L Sodium Butyrate) was added, and culture temperature was changed to 36.5° C. At 216 hours (day 9), 10.8 L of Feed #3 (1×CD-CHO+50 g/L Glucose+50 mL/L Glutamax-1™+250 mL/L Yeastolate+1.80 g/L Sodium Butyrate) was added, and culture temperature was changed to 36° C. At 264 hours (day 11), 10.8 L of Feed #4 (lx CD-CHO+33 g/L Glucose+33 mL/L Glutamax-1™+250 mL/L Yeastolate+0.92 g/L Sodium Butyrate) was added, and culture temperature was changed to 35.5° C. The addition of the feed media was observed to dramatically enhance the production of soluble rHuPH20 in the final stages of production. The reactor was harvested at 14 or 15 days or when the viability of the cells dropped below 40%. The process resulted in a final productivity of 17,000 Units per ml with a maximal cell density of 12 million cells/mL. At harvest, the culture was sampled for mycoplasma, bioburden, endotoxin and viral in vitro and in vivo, Transmission Electron Microscopy (TEM) and enzyme activity.

The culture was pumped by a peristaltic pump through four Millistak filtration system modules (Millipore) in parallel, each containing a layer of diatomaceous earth graded to 4-8 μm and a layer of diatomaceous earth graded to 1.4-1.1 μm, followed by a cellulose membrane, then through a second single Millistak filtration system (Millipore) containing a layer of diatomaceous earth graded to 0.4-0.11 μm and a layer of diatomaceous earth graded to <0.1 μm, followed by a cellulose membrane, and then through a 0.22 μm final filter into a sterile single use flexible bag with a 350 L capacity. The harvested cell culture fluid was supplemented with 10 mM EDTA and 10 mM Tris to a pH of 7.5. The culture was concentrated 10× with a tangential flow filtration (TFF) apparatus using four Sartoslice TFF 30 kDa molecular weight cut-off (MWCO) polyether sulfone (PES) filters (Sartorius), followed by a 10× buffer exchange with 10 mM Tris, 20 mM $Na_2SO_4$, pH 7.5 into a 0.22 μm final filter into a 50 L sterile storage bag.

The concentrated, diafiltered harvest was inactivated for virus. Prior to viral inactivation, a solution of 10% Triton X-100, 3% tri (n-butyl) phosphate (TNBP) was prepared. The concentrated, diafiltered harvest was exposed to 1% Triton X-100, 0.3% TNBP for 1 hour in a 36 L glass reaction vessel immediately prior to purification on the Q column.

B. Purification of Gen2 Soluble rHuPH20

A Q Sepharose (Pharmacia) ion exchange column (9 L resin, H=29 cm, D=20 cm) was prepared. Wash samples were collected for a determination of pH, conductivity and endotoxin (LAL) assay. The column was equilibrated with 5 column volumes of 10 mM Tris, 20 mM Na2SO4, pH 7.5. Following viral inactivation, the concentrated, diafiltered harvest (Example 2A) was loaded onto the Q column at a flow rate of 100 cm/hr. The column was washed with 5 column volumes of 10 mM Tris, 20 mM Na2SO4, pH 7.5 and 10 mM Hepes, 50 mM NaCl, pH 7.0. The protein was eluted with 10 mM Hepes, 400 mM NaCl, pH 7.0 into a 0.22 μm final filter into sterile bag. The eluate sample was tested for bioburden, protein concentration and hyaluronidase activity. $A_{280}$ absorbance readings were taken at the beginning and end of the exchange.

Phenyl-Sepharose (Pharmacia) hydrophobic interaction chromatography was next performed. A Phenyl-Sepharose (PS) column (19-21 L resin, H=29 cm, D=30 cm) was prepared. The wash was collected and sampled for pH, conductivity and endotoxin (LAL assay). The column was equilibrated with 5 column volumes of 5 mM potassium phosphate, 0.5 M ammonium sulfate, 0.1 mM CaCl2, pH 7.0. The protein eluate from the Q sepharose column was supplemented with 2M ammonium sulfate, 1 M potassium phosphate and 1 M CaCl2 stock solutions to yield final concentrations of 5 mM, 0.5 M and 0.1 mM, respectively. The protein was loaded onto the PS column at a flow rate of 100 cm/hr and the column flow thru collected. The column was washed with 5 mM potassium phosphate, 0.5 M ammonium sulfate and 0.1 mM CaCl2 pH 7.0 at 100 cm/hr and the wash was added to the collected flow thru. Combined with the column wash, the flow through was passed through a 0.22 µm final filter into a sterile bag. The flow through was sampled for bioburden, protein concentration and enzyme activity.

An aminophenyl boronate column (ProMedics) was prepared. The wash was collected and sampled for pH, conductivity and endotoxin (LAL assay). The column was equilibrated with 5 column volumes of 5 mM potassium phosphate, 0.5 M ammonium sulfate. The PS flow through containing purified protein was loaded onto the aminophenyl boronate column at a flow rate of 100 cm/hr. The column was washed with 5 mM potassium phosphate, 0.5 M ammonium sulfate, pH 7.0. The column was washed with 20 mM bicine, 0.5 M ammonium sulfate, pH 9.0. The column was washed with 20 mM bicine, 100 mM sodium chloride, pH 9.0. The protein was eluted with 50 mM Hepes, 100 mM NaCl, pH 6.9 and passed through a sterile filter into a sterile bag. The eluted sample was tested for bioburden, protein concentration and enzyme activity.

The hydroxyapatite (HAP) column (Biorad) was prepared. The wash was collected and tested for pH, conductivity and endotoxin (LAL assay). The column was equilibrated with 5 mM potassium phosphate, 100 mM NaCl, 0.1 mM $CaCl_2$, pH 7.0. The aminophenyl boronate purified protein was supplemented to final concentrations of 5 mM potassium phosphate and 0.1 mM $CaCl_2$ and loaded onto the HAP column at a flow rate of 100 cm/hr. The column was washed with 5 mM potassium phosphate, pH 7, 100 mM NaCl, 0.1 mM $CaCl_2$. The column was next washed with 10 mM potassium phosphate, pH 7, 100 mM NaCl, 0.1 mM $CaCl_2$. The protein was eluted with 70 mM potassium phosphate, pH 7.0 and passed through a 0.22 µm sterile filter into a sterile bag. The eluted sample was tested for bioburden, protein concentration and enzyme activity.

The HAP purified protein was then passed through a viral removal filter. The sterilized Viosart filter (Sartorius) was first prepared by washing with 2 L of 70 mM potassium phosphate, pH 7.0. Before use, the filtered buffer was sampled for pH and conductivity. The HAP purified protein was pumped via a peristaltic pump through the 20 nM viral removal filter. The filtered protein in 70 mM potassium phosphate, pH 7.0 was passed through a 0.22 µm final filter into a sterile bag. The viral filtered sample was tested for protein concentration, enzyme activity, oligosaccharide, monosaccharide and sialic acid profiling. The sample also was tested for process related impurities.

Example 3

Determination of Hyaluronidase Activity of Soluble rHuPH20

Hyaluronidase activity of soluble rHuPH20 in samples such as cell cultures, plasma, purification fractions and purified solutions was determined using either a turbidimetric assay, which is based on the formation of an insoluble precipitate when hyaluronic acid binds with serum albumin, or a biotinylated-hyaluronic acid substrate assay, which measures the amount of enzymatically active rHuPH20 or PEGPH20 by the digestion of biotinylated hyaluronic acid (b-HA) substrate non-covalently bound to plastic multi-well microtiter plates.

A. Microturbidity Assay

Hyaluronidase activity of soluble rHuPH20 is measured by incubating soluble rHuPH20 with sodium hyaluronate (hyaluronic acid) for a set period of time (10 minutes) and then precipitating the undigested sodium hyaluronate with the addition of acidified serum albumin. The turbidity of the resulting sample is measured at 640 nm after a 30 minute development period. The decrease in turbidity resulting from enzyme activity on the sodium hyaluronate substrate is a measure of the soluble rHuPH20 hyaluronidase activity. The method is performed using a calibration curve generated with dilutions of a soluble rHuPH20 assay working reference standard, and sample activity measurements are made relative to this calibration curve.

Dilutions of the sample were prepared in Enzyme Diluent Solutions. The Enzyme Diluent Solution was prepared by dissolving 33.0±0.05 mg of hydrolyzed gelatin in 25.0 mL of the 50 mM PIPES Reaction Buffer (140 mM NaCl, 50 mM PIPES, pH 5.5) and 25.0 mL of sterile water for injection (SWFI), and diluting 0.2 mL of 25% Buminate solution into the mixture and vortexing for 30 seconds. This was performed within 2 hours of use and stored on ice until needed. The samples were diluted to an estimated 1-2 U/mL. Generally, the maximum dilution per step did not exceed 1:100 and the initial sample size for the first dilution was not less than 20 µL. The minimum sample volumes needed to perform the assay were as follows: In-process Samples, FPLC Fractions: 80 µl; Tissue Culture Supernatants: 1 mL; Concentrated Material: 80 µL; Purified or Final Step Material: 80 µL. The dilutions were made in triplicate in a Low Protein Binding 96-well plate, and 30 µL of each dilution was transferred to Optilux black/clear bottom plates (BD BioSciences).

Dilutions of known soluble rHuPH20 with a concentration of 2.5 U/mL were prepared in Enzyme Diluent Solution to generate a standard curve and added to the Optilux plate in triplicate. The dilutions included 0 U/mL, 0.25 U/mL, 0.5 U/mL, 1.0 U/mL, 1.5 U/mL, 2.0 U/mL, and 2.5 U/mL. "Reagent blank" wells that contained 60 µL of Enzyme Diluent Solution were included in the plate as a negative control. The plate was then covered and warmed on a heat block for 5 minutes at 37° C. The cover was removed and the plate was shaken for 10 seconds. After shaking, the plate was returned to the heat block and the MULTIDROP 384 Liquid Handling Device was primed with the warm 0.25 mg/mL sodium hyaluronate solution (prepared by dissolving 100 mg of sodium hyaluronate (LifeCore Biomedical) in 20.0 mL of SWFI. This was mixed by gently rotating and/or rocking at 2-8° C. for 2-4 hours, or until completely dissolved). The reaction plate was transferred to the MULTIDROP 384 and the reaction was initiated by pressing the start key to dispense 30 µL sodium hyaluronate into each well. The plate was then removed from the MULTIDROP 384 and shaken for 10 seconds before being transferred to a heat block with the plate cover replaced. The plate was incubated at 37° C. for 10 minutes.

The MULTIDROP 384 was prepared to stop the reaction by priming the machine with Serum Working Solution and changing the volume setting to 240 µL. (25 mL of Serum Stock Solution [1 volume of Horse Serum (Sigma) was diluted with 9 volumes of 500 mM Acetate Buffer Solution and the pH was adjusted to 3.1 with hydrochloric acid] in 75 mL of 500 mM Acetate Buffer Solution). The plate was removed from the heat block and placed onto the MULTIDROP 384, and 240 µL of serum Working Solutions was dispensed into the wells. The plate was removed and shaken on a plate reader for 10 seconds. After a further 15 minutes, the turbidity of the samples was measured at 640 nm and the hyaluronidase activity (in U/mL) of each sample was determined by fitting to the standard curve.

Specific activity (Units/mg) was calculated by dividing the hyaluronidase activity (U/ml) by the protein concentration (mg/mL).

B. Biotinylated Hyaluronan Assay

The biotinylated-hyaluronic acid assay measures the amount of enzymatically active rHuPH20 or PEGPH20 in biological samples by the digestion of a large molecular weight (~1.2 megadaltons) biotinylated hyaluronic acid (b-HA) substrate non-covalently bound to plastic multi-well microtiter plates. The rHuPH20 or PEGPH20 in standards and samples are allowed to incubate in a plate coated with b-HA at 37° C. After a series of washes, remaining uncleaved/bound b-HA is treated with Streptavidin Horseradish Peroxidase conjugate (SA-HRP). Reaction between immobilized SA-HRP and the chromogenic substrate, 3,3',5,5'-tetramethylbenzidine (TMB), produces a blue colored solution. After stopping the reaction with acid, formation of the soluble yellow reaction product is determined by reading the absorbance at 450 nm using a microtiter plate spectrophotometer. The decrease in absorbance at 450 nm resulting from enzyme activity on the biotinylated hyaluronic acid (b-HA) substrate is a measure of the soluble rHuPH20 hyaluronidase activity. The method is performed using a calibration curve generated with dilutions of a soluble rHuPH20 or PEGPH20 reference standard, and sample activity measurements are made relative to this calibration curve.

Dilutions of the sample and calibrator were prepared in Assay Diluent. The Assay Diluent was prepared by adding 1% v/v pooled plasma (from the appropriate species) to 0.1% (w/v) BSA in HEPES, pH 7.4. This was prepared daily and stored at 2-8° C. Depending upon the species type as well as the anticipated hyaluronidase level, single or multiple dilutions were prepared to ensure at least one sample dilution would fall within the range of the calibration curve. To guide the selection of test sample dilution(s), information known about the dose of hyaluronidase administered, the route of administration, approximate plasma volume of the species and the time point were used to estimate the hyaluronidase activity levels. Each sample dilution was mixed as it was prepared by brief pulse-vortexing and pipet tips were changed in between each dilution. In general, the dilutions began with an initial 50 or 100-fold dilution followed by additional serial dilutions. A seven-point calibration curve of rHuPH20 or PEGPH20 (depending upon the treatment administered) was prepared ranging in concentration from 0.004 to 3.0 U/mL for rHuPH20 and from 0.037 to 27 U/mL for PEGPH20. One-hundred microliters (100 µL) of each test sample dilution and calibration curve point was applied to triplicate wells of a 96-well microtiter plate (Immulon 4HBX, Thermo) that had been previously coated with 100 µL per well of b-HA at 0.1 mg/mL and blocked with 250 µL of 1.0% (w/v) Bovine Serum Albumin in PBS. Plate(s) were covered with an adhesive plate seal and incubated at 37° C. for approximately 90 minutes. At the end of the incubation period, the adhesive seal was removed from the plate, samples were aspirated and the plate washed five (5) times with 300 µL per well Wash Buffer (10 mM Phosphate Buffer, 2.7 mM Potassium Chloride, 137 mM Sodium Chloride, pH 7.4, with 0.05% (v/v) Tween 20, PBST) using an automated plate washer (BioTek ELx405 Select CW, Program '4HBX1'). One hundred microliters of Streptavidin-HRP Conjugate Working Solution [Streptavidin-HRP conjugate (1:5,000 v/v) in 20 mM Tris-HCl, 137 mM Sodium Chloride, 0.025% (v/v) Tween 20, 0.1% (w/v) Bovine Serum Albumin] was added per well. The plate was sealed and allowed to incubate at ambient temperature for approximately 60 minutes without shaking and protected from light. At the end of the incubation period, the adhesive seal was removed from the plate, samples were aspirated and the plate washed five (5) times with 300 µL per well Wash Buffer as described above. TMB solution (at ambient temperature) was added to each well and allowed to incubate protected from light for approximately five (5) minutes at room temperature. TMB Stop Solution (KPL, Catalog #50-85-06) was then added as 100 µL per well. The absorbance of each well at 450 nm was determined using a microtiter plate spectrophotometer. The response of the Calibration Curve on each plate was modeled using a 4-parameter logistic curve fit. The hyaluronidase activity of each unknown was calculated by interpolation from the calibration curve, corrected for sample dilution factor, and reported in U/mL.

Example 4

Preparation of PEGylated rHuPH20

In this example, rHuPH20 was PEGylated by reaction of the enzyme with linear N-hydroxysuccinimidyl ester of methoxy poly(ethylene glycol) butanoic acid (mPEG-SBA-30K).

A. Preparation of mPEG-SBA-30K

In order to generate PEGPH20, rHuPH20 (which is approximately 60 KDa in size) was covalently conjugated to a linear N-hydroxysuccinimidyl ester of methoxy poly(ethylene glycol) butanoic acid (mPEG-SBA-30K), having an approximate molecular weight of 30 kDa. The structure of mPEG-SBA is shown below, where n≈681.

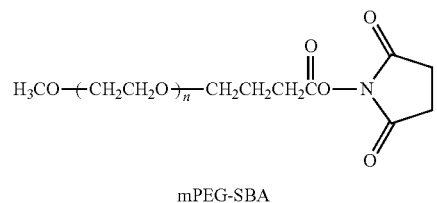

mPEG-SBA

Methods used to prepare the mPEG-SBA-30K that was used to PEGylate rHuPH20 are described, for example, in U.S. Pat. No. 5,672,662. Briefly, the mPEG-SBA-30K is made according to the following procedure:

A solution of ethyl malonate (2 equivalents) dissolved in dioxane is added drop by drop to sodium hydride (2 equivalents) and toluene under a nitrogen atmosphere. mPEG methane sulfonate (1 equivalent, MW 30 kDa, Shearwater) is dissolved in toluene and added to the above mixture. The resulting mixture is refluxed for approximately 18 hours. The reaction mixture is concentrated to half its original volume, extracted with 10% aqueous NaCl solution, extracted with 1% aqueous hydrochloric acid, and the aqueous extracts are combined. The collected aqueous layers are extracted with dichloromethane (3×) and the organic layer is dried with magnesium sulfate, filtered and evaporated to dryness. The resulting residue is dissolved in 1N sodium hydroxide containing sodium chloride and the mixture is stirred for 1 hour. The pH of the mixture is adjusted to approximately 3 by addition of 6N hydrochloric acid. The mixture is extracted with dichloromethane (2×).

The organic layer is dried over magnesium sulfate, filtered, concentrated, and poured into cold diethyl ether. The precipitate is collected by filtration and dried under vacuum. The resulting compound is dissolved in dioxane and refluxed for 8 hours and then concentrated to dryness. The resulting residue is dissolved in water and extracted with dichloromethane (2×), dried over magnesium sulfate, and the solution is concentrated by rotary evaporation and then poured into cold diethyl ether. The precipitate is collected by filtration and dried under vacuum. The resulting compound (1 equivalent) is dissolved in dichloromethane and N-hydroxysuccinimide (2.1 equivalents) is added. The solution is cooled to 0° C. and a solution of dicyclohexylcarbodiimide (2.1 equivalents) in dichloromethane is added dropwise. The solution is stirred at room temperature for approximately 18 hours. The reaction mixture is filtered, concentrated and precipitated in diethyl ether. The precipitate is collected by filtration and dried under vacuum to afford the powder mPEG-SBA-30K which is then frozen at ≤−15° C.

B. Conjugation of mPEG-SBA-30K to rHuPH20

To make the PEGPH20, mPEG-SBA-30K was coupled to the amino group(s) of rHuPH20 by covalent conjugation, providing stable amide bonds between rHuPH20 and mPEG, as shown below, where n≈681.

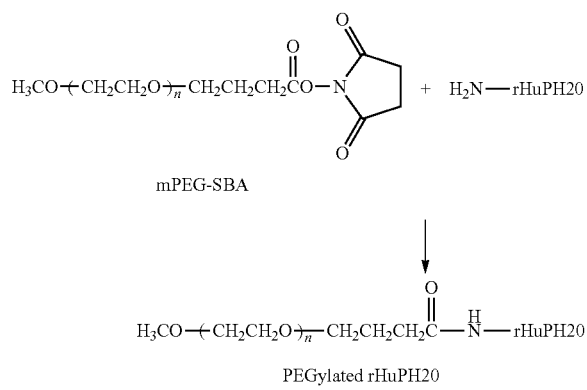

Prior to conjugation, the rHuPH20 purified bulk protein made in Example 2B was concentrated to 10 mg/mL, using a 10 kDa polyethersulfone (PES) tangential flow filtration (TFF) cassettes (Sartorius) with a 0.2 m² filtration area, and buffer exchanged against 70 mM Potassium Phosphate at pH 7.2. The concentrated protein was then stored at 2-8° C. until use.

To conjugate the rHuPH20, the mPEG-SBA-30K (Nektar) was thawed at room temperature in the dark for not longer than 2 hours. Depending on the batch size, a sterile 3" stir bar was placed into a 1 or 3 liter Erlenmeyer flask and buffer exchanged rHuPH20 protein was added. Five grams of dry mPEG-SBA-30K powder per gram of rHuPH20 (10:1 molar ratio of mPEG-SBA-30K:rHuPH20) was added to the flask under a vaccuum hood and the mixture was mixed for 10 minutes or until the mPEG-SBA-30K was complete dissolved. The stir rate was set such that vortexing occurred without foaming.

The solution was then filtered under a class 100 hood by pumping the solution, via peristaltic pump, through a 0.22 µm polystyrene, cellulose acetate filter capsule (Corning 50 mL Tubetop filter) into a new 1 or 3 liter Erlenmeyer flask containing a sterile 3" stir bar. The volume of the PEGPH20 reaction mixture was determined by mass (1 g/mL density) and the 0.22 µm filter used for filtration was examined in a post-use integrity test.

The mixture was then placed on a stir plate at 2-8° C. and mixed for 20±1 hours in the dark. The stir rate was again set such that vortexing occurred without foaming. The entire Erlenmeyer container was wrapped in foil to protect the solution from light. After mixing, the reaction was quenched by adding 1M glycine to a final concentration of 25 mM. Samples were removed from the container to test pH and conductivity. The pH and conductivity were then adjusted by adding to a solution of 5 mM Tris Base (5.65 L/L) and 5 mM Tris, 10 mM NaCl, pH 8.0 (13.35 L/L) to proceed with Q Sepharose purification.

A QFF Sepharose (GE Healthcare) ion exchange column (Height=21.5-24.0 cm, Diameter=20 cm) was prepared by equilibration with 5 column volumes (36 L) of 5 mM Tris, 10 mM NaCl, pH 8.0. The conjugated product was loaded onto the QFF column at a flow rate of 95 cm/hr. The column was then washed with 11 L of equilibration buffer (5 mM Tris, 10 mM NaCl, pH 8.0) at a flow rate of 95 cm/hr followed by a wash with 25 L of equilibration buffer at a flow rate of 268 cm/hr. The protein product was then eluted with 5 mM Tris, 130 mM NaCl, pH 8.0 at a flow rate of 268 cm/hr. The resulting purified PEGPH20 was concentrated to 3.5 mg/mL, using a 30 kDa polyethersulfone (PES) tangential flow filtration (TFF) cassettes (Sartorius) with a 0.2 m² filtration area, and buffer exchanged against 10 mM Histidine, 130 mM NaCl at pH 6.5. The resulting material was tested for enzyme activity as described in Example 3. The PEGylated rHuPH20 material at a concentration of 3.5 mg/mL (final enzyme activity 140,000 U/mL) was filled, in 3 mL volumes, into 5 mL glass vials with a siliconized bromobutyl rubber stopper and aluminum flip-off seal, and frozen (frozen overnight in a −20° C. freezer, then put in a −80° C. freezer for longer storage). The PEGylated rHuHP20 contained approximately 4.5 moles of PEG per mole of rHuPH20.

B. Analysis of PEGylated rHuPH20

The PEGylated rHuPH20 (PEGPH20) material was assayed by gel electrophoresis. Three batches of PEGPH20, made as described in Example 4A above, revealed an identical pattern of multiple bands, representing unreacted PEG and multiple species of PEGPH20 conjugates, which migrated at different distances. Based on comparison with migration of a molecular weight marker, the bands representing the species ranged from approximately 90 KDa to 300 KDa, with three dark bands migrating above the 240 KDa marker. These data indicated that the PEGPH20, generated by covalent conjugation of mPEG-SBA-30K, contained a heterogeneous mixture of PEGPH20 species, likely including mono-, di- and tri-PEGylated proteins. The lack of a visible band at 60 KDa suggested that all the protein had reacted with the PEG, and that no detectable native rHuPH20 was present in the mixture.

Example 5

Competency of Tumor Cells to Form Pericellular Matrix and Relationship to Tumor Cell Hyaluronan (HA) Content, Levels of Hyaluronan Synthase (HAS), and Hyaluronidase (Hyal) Expression A. Comparison of Tumor Cell HA Content, Expression of HAS1, 2, 3 and Hyal 1 and 2, and Pericellular Matrix Formation In this Example, the amount of endogenous HA synthesis enzymes, hyaluronan synthase (HAS) 1, 2, and 3, hyaluronidase (Hyal) 1 and (Hyal) 2 and the amount of hyaluronan (HA) accumulation in tumor cells was compared to show that each correlated to pericellular matrix formation by the tumor cells.

1. Cell Lines Used in the Study

Ten cell lines from tumors of various tissue origin (e.g., prostate, breast, ovarian, pancreatic, and lung) and species origin (e.g., human, mouse and rat) were examined in the study. The following cell lines were obtained from the American Type Culture Collection (ATCC): 4T1 mouse breast tumor (ATCC CRL-2539), PC-3 human prostate adenocarcinoma (ATCC CRL-1435), BxPC-3 human pancreatic adenocarcinoma (ATCC CRL-1687), MDA MB 231 human breast adenocarcinoma (ATCC HTB-26), Mat-Lylu rat malignant prostate carcinoma (ATCC JHU-92), AsPc-1 human pancreatic adenocarcinoma (ATCC CRL-1682), DU-145 human prostate carcinoma (ATCC HTB-81), and MIA PaCa 2 human pancreatic carcinoma (ATCC CRL-1420). The ATCC cell lines were grown in recommended culture medium containing 10% FBS at 37° C. in a humidified incubator supplied with 5% $CO_2$/95% air. MDA-MB-231-Luc (Cat. No. D3H2LN) cells, which express the North American Firefly Luciferase gene, were purchased from Caliper Life Sciences Inc. and grown in RPMI containing 10% FBS.

The DU-145/HAS2 and MDA-MB-231-Luc/HAS2 cell lines were generated by transduction of the DU-145 and MDA-MB-231-Luc cell lines with a retrovirus encoding hyaluronan synthase 2 (HAS2) (SEQ ID NO:195). To generate the HAS2 retrovirus, N-terminal His6-tagged hHAS2 cDNA (SEQ ID NO:196) was inserted into the AvrII and NotI sites of the vector pLXRN (SEQ ID NO:197; Clontech, Cat. No. 631512), which includes the neomycin resistance gene, to create pLXRN-hHAS2 (SEQ ID NO: 201). The pLXRN-hHAS2 His plasmid was then co-transfected with pVSV-G envelope vector (SEQ ID NO:198 Clontech, part of Cat. No. 631530) into GP-293 cells using Lipofectamine 2000 reagent (Life Technologies). A DU-145 Mock cell line also was generated by co-transfection of the empty pLXRN plasmid and pVSV-G envelope vector.

The virus titer was determined by quantitative PCR method (Retro-X™ qRT-PCR Titration Kit; Clontech, Catalog No. 631453) using the following primers (Clontech Catalog No. #K1060-E):

```
pLXSN 5' primer (1398-1420):
5'-CCCTTGAACCTCCTCGTTCGACC-3';      (SEQ ID NO: 199)
pLXSN 3' primer (1537-1515):
5'-GAGCCTGGGGACTTTCCACACCC-3'.      (SEQ ID NO: 200)
```

To establish HAS2 expression cell lines, 70% confluent cancer cells, DU-145 or MDA MB 231 Luc, were incubated with a 60:1 to 6:1 ratio of retrovirus in DMEM (Mediatech) containing 10% FBS for 72 hours. The cultures were maintained in selective medium containing 200 µg/mL of G418. Stable HAS2-expressing cancer cells were generated after 2 weeks of G418 conditional medium selection.

2. Quantification of Hyaluronic Acid

A hyaluronan binding protein (HABP)-based assay was employed to determine the amount of hyaluronan produced by the tumor cells. HABP-based assays are preferable to chemical methods for measuring HA as a tumor microenvironment (TME) biomarker because the HABP preferentially detects HA composed of at least 15 (n-acetyl glucose-glucuronic acid) disaccharides, which is competent to bind hyaladherins (HA binding proteins) (see, e.g., Haserodt S, et al. (2011) Glycobiology 21: 175-183).

Tumor cells were seeded at $1 \times 10^6$ cells in 75 cm$^2$ flasks and incubated for 24 hours. Tissue culture supernatants were harvested for quantitation of HA using an enzyme-linked HABP sandwich assay (R&D Systems, Catalog No. DY3614), which uses recombinant human aggrecan as a HA capture and detection reagent (recombinant human aggrecan G1-IGD-G2 domains, Val20-Gly676 of Accession No. NP_037359 (SEQ ID NO: 202) with a C-terminal 10-HIS tag, R&D Systems, Catalog No. 1220-PG). The assay for HA detection was performed according to the manufacturer's instructions. Briefly, assay plates were coated with recombinant human aggrecan, and samples (i.e. tissue culture supernatants) containing HA were added to the plate (three independent replicates of each cell line were tested). The plates were washed and the bound HA was detected using biotinylated recombinant human aggrecan. After removing the unbound probe, streptavidin conjugated to horseradish peroxidase (HRP) was added as a secondary detection reagent. After washing the plate, the bound HRP was detected by incubation with the 1:1 $H_2O_2$/Tetramethylbenzidine substrate solution (R&D Systems) and quantitated by optical density detection at 450 nm using a SpectraMax M3 Multi-Mode Microplate Reader (Molecular Devices, CA). Concentration of HA in the culture media for each tumor cell type was expressed as mean HA concentration (ng/mL) in culture media (Table 5).

3. Quantification of HAS1, HAS2, HAS3, HYAL1 and HYAL2 mRNA Expression

RNA was extracted from cell pellets using an RNeasy® Mini Kit (Qiagen GmbH) according to the manufacturer's instructions. The extracted RNA was then quantified using a NanoDrop spectrophotometer (NanoDrop Technologies, Wilmington, Del.). Quantitative real-time PCR (qRT-PCR) using gene-specific primers was used to quantitate the relative mRNA levels of each hyaluronan synthase and hyaluronidase. qRT-PCR primers were purchased from Bio Applied Technologies Joint, Inc, (San Diego, Calif.). The DNA sequences for the primers used in the individual PCR reactions were as follows:

TABLE 4

Primer sequences used for qRT-PCR analysis of HAS and HYAL gene expression

| Gene | Forward primer | Reverse primer |
|---|---|---|
| HAS1 | 5'-TACAACCAGAAGTTCCTGGG-3' (SEQ ID NO: 395) | 5'-CTGGAGGTGTACTTGGTAGC-3' (SEQ ID NO: 396) |
| HAS2 | 5'-GTATCAGTTTGGTTTACAATC-3' (SEQ ID NO: 397) | 5'-GCACCATGTCATATTGTTGTC-3' (SEQ ID NO: 398) |
| HAS3 | 5'-CTTAAGGGTTGCTTGCTTGC-3' (SEQ ID NO: 399) | 5'-GTTCGTGGGAGATGAAGGAA-3' (SEQ ID NO: 400) |

TABLE 4-continued

Primer sequences used for qRT-PCR analysis of HAS and HYAL gene expression

| Gene | Forward primer | Reverse primer |
|---|---|---|
| HYAL1 | 5'-GTGCTGCCCTATGTCCAGAT-3' (SEQ ID NO: 401) | 5'-ATTTTCCCAGCTCACCCAGA-3' (SEQ ID NO: 402) |
| HYAL2 | 5'-TCTACCATTGGCGAGAGTG-3' (SEQ ID NO: 403) | 5'-GCAGCCGTGTCAGGTAAT-3' (SEQ ID NO: 404) |
| GAPDH | 5'-TGCACCACCAACTGCTTAGC-3' (SEQ ID NO: 405) | 5'-GGCATGGACTGTGGTCATGAG-3' (SEQ ID NO: 406) |

For the PCR reactions, samples were mixed with iQ SYBR Green master mix (Bio-Rad) and the designated primer pairs for each gene. The PCR reactions were performed on a Bio-Rad Chromo 4 qPCR device. First strand synthesis was performed under the following conditions: 42° C. for 2 minutes for the DNA elimination reaction, 42° C. for 15 minutes for reverse-transcription, and 3 minutes at 95° C. for inactivation of reverse-transcriptase. For amplification, 3 minutes initial denaturation at 95° C., 45 cycles of 15 seconds denaturation and 1 minute annealing extension at 58° C. were used. The gene expression CT value from each sample was calculated by normalizing with the internal housekeeping gene GAPDH and relative values were plotted. Table 5 lists the CT values for each tumor cell type for each gene assayed.

4. Assay for Pericellular Matrix Formation

Monolayer cultures of the ten cell lines were grown and tested for aggrecan-facilitated pericellular matrix formation. To visualize aggrecan-mediated HA pericellular matrices in vitro, particle exclusion assays were used as previously described in Thompson C B, et al. (2010) *Mol Cancer Ther* 9: 3052-3064, with some modifications. Briefly, cells were seeded at $1 \times 10^5$ cells per well in a six-well plate for 24 hours, and then treated with culture cell media alone or media containing 1000 U/mL rHuPH20 at 37° C. for 1 hour. Pre-treatment with rHuPH20 inhibits formation of the pericellular matrix; thus, it was employed as a negative control for pericellular matrix formation for each cell type. The cells were then incubated with 0.5 mg/mL of bovine aggrecan (Sigma-Aldrich) at 37° C. for 1 hour. Subsequently, media were removed and replaced with $10^8$/mL suspension of 2% glutaraldehyde-fixed mouse red blood cells (RBCs), isolated from Balb/c mouse (Taconic, Hudson, N.Y.), in PBS, pH 7.4. The particles were allowed to settle for 15 minutes. The cultures were then imaged with a phase-contrast microscope coupled with a camera scanner and imaging program (Diagnostic Instruments). Particle exclusion area and cell area were measured using the SPOT Advance program (Diagnostic Instruments, Inc., Sterling Heights, Mich.). Pericellular matrix area was calculated as matrix area minus cell area, and expressed as $\mu m^2$ (Table 5).

5. Results: Comparison of Tumor Cell HA Content, and HAS and HYAL Expression to Pericellular Matrix Formation The concentration of HA in conditioned media as determined by the HABP-based detection assay was found to correlate with the area of aggrecan-mediated pericellular matrix formed by the tumor cells in monolayer culture (Table 5, P<0.0029). Further, cell lines that were engineered to express hyaluronan synthase 2 (HAS2), DU-145/HAS2 and MDA-MB-231/HAS2, displayed increased HA production and enhanced pericellular matrix formation in vitro compared to the respective parental cell lines. In contrast, no correlation was found between pericellular matrix formation and relative levels of HAS1, 2, or 3 or Hyal 1 or 2 mRNA expression. These findings indicate that the direct measurement of tumor cell-associated HA specifically provides a predictor for pericellular matrix formation.

TABLE 5

Quantitation of HA production, pericellular matrix formation, HAS and Hyal expression in tumor cell lines

| Tumor Cell Line | PM[1] | HA in CM[2] | HAS isoform mRNA[3] | | | Hyaluronidase isoform mRNA[4] | |
|---|---|---|---|---|---|---|---|
| | | | HAS1 | HAS2 | HAS3 | Hyal1 | Hyal2 |
| 4T1 | 1552.00 | 473.83 | NE | NE | NE | NE | NE |
| MDA-MB-231/HAS2 | 1088.55 | 372.20 | 2.48 | 19.90 | 0.09 | 0.14 | 0.53 |
| PC3 | 1072.20 | 294.45 | 1.41 | 0.34 | 6.32 | 0.14 | 1.19 |
| DU-145/HAS2 | 981.00 | 7417.00 | 1.08 | 7.81 | 0.65 | 0.34 | 1.04 |
| BxPC3 | 967.20 | 467.12 | 1.00 | 1.00 | 1.00 | 1.00 | 1.00 |
| MDA-MB-231 WT | 770.45 | 256.90 | 3.39 | 0.54 | 0.05 | 0.13 | 0.64 |
| MatLylu | 760.55 | 265.91 | NE | NE | NE | NE | NE |
| AsPC-1 | 524.20 | 66.47 | 1.87 | 1.65 | 1.28 | 0.81 | 1.91 |
| DU-145 WT | 252.10 | 41.79 | 1.01 | 0.03 | 1.51 | 0.17 | 0.70 |
| MIA PaCa-2 | 129.40 | 0.00 | 0.46 | 0.00 | 0.04 | 0.28 | 0.72 |
| Correlation Coefficient (Spearman P value) | — | 0.0029 | 0.23 | 0.34 | 0.71 | 0.66 | 0.36 |

NE: not evaluated
[1]Pericellular matrix area ($\mu m^3$) assessed via particle exclusion assay.
[2]Mean HA concentration (ng/mL) in culture media (n = 3, independent cultures).
[3,4]Hyaluronan synthase (HAS) and hyaluronidase (Hyal) expression as determined by real-time RT-PCR. Ct values were normalized by GAPDH mRNA and the fold differences are relative to BxPC3 expression.

Example 6

Measurement of Tumor Cell Hyaluronan Concentration and Relationship to Anti-Tumor Activity of PEGPH20

In this example, the concentration of hyaluronan in different tumor cell lines was assessed by immunohistochemical analysis and compared to the ability of PEGPH20 to inhibit tumor growth of xenograft tumors generated from the tumor cell lines and tumor colony growth of a HA rich tumor cell line.

A. Comparison of HA Content with PEGPH20 Efficacy in Various Xenograft Tumor Models 1. Xenograft Tumor Models Fourteen tumor cell line-derived xenograft tumors were generated from the following tumor cell lines: DU-145 human prostate carcinoma (ATCC HTB-81 mock transfected with empty pLXRN plasmid, see Example 5.A.1), DU-145 HAS2 (see Example 5.A.1), MDA MB 231 human breast adenocarcinoma (ATCC HTB-26), MDA-MB-231\Luc (D3H2LN, Caliper Life Sciences), MDA MB 231 Luc/HAS2 (see Example 5.A.1), SKOV3 human ovarian carcinoma (ATCC HTB-77), AsPc-1 human pancreatic adenocarcinoma (ATCC CRL-1682), MIA PaCa 2 human pancreatic carcinoma (ATCC CRL-1420), 4T1 mouse breast tumor (ATCC CRL-2539), BxPC-3 human pancreatic adenocarcinoma (ATCC CRL-1687), Mat-Lylu rat malignant prostate carcinoma (ATCC JHU-92), and PC-3 human prostate adenocarcinoma (ATCC CRL-1435). Tumor cell lines were maintained as described in Example 5. LUM 697 and LUM 330 human tumor explants were obtained from Crown Bioscience, Beijing China.

Six to eight week old nu/nu (Ncr) athymic nude mice (Taconic) or Balb/c (Harlan) or Balb/c nude mice (Shanghai Laboratory Animal Center, CAS (SLACCAS); see Example 7) were housed in micro-isolator cages, in an environment-controlled room on a 12-hour light/12-hour dark cycle, and received sterile food and water ad libitum. All animal studies were conducted in accordance with approved IACUC protocols.

For generation of tumors, mice were inoculated with tumor cells peritibially (intramuscular injection adjacent to the right tibia periosteum), subcutaneously (s.c., right hind leg), or in mammary fat pad according to Table 6 below.

TABLE 6

Animal Tumor Models

| Models | Tumor Type (Source) | Mice | Animal Source | Inoculation Site | Cell Number |
|---|---|---|---|---|---|
| Du145 Mock | Prostate Ca. (H) | Ncr nu/nu; female | Taconic | peritibially | $5 \times 10^6/0.05$ mL |
| MDA MB 231 | Breast Ca. (H) | Ncr nu/nu; female | Taconic | peritibially | $1 \times 1 \times 1$ mm$^3$ tissue cube |
| SKOV3 | Ovarian Ca. (H) | Ncr nu/nu; female | Taconic | s.c. | $1 \times 10^6/0.1$ mL |
| MDA MB 231Luc | Breast Ca. (H) | Ncr nu/nu; female | Taconic | peritibially | $1 \times 10^6/0.1$ mL |
| MDA MB 231 Luc/HAS2 | Breast Ca. (H) | Ncr nu/nu; female | Taconic | peritibially | $1 \times 10^6/0.1$ mL |
| AsPc-1 | Pancreatic Ca. (H) | Ncr nu/nu; female | Taconic | s.c. | $1 \times 10^7/0.1$ mL |
| MIA PaCa 2 | Pancreatic Ca. (H) | Ncr nu/nu; female | Taconic | s.c. | $1 \times 10^7/0.1$ mL |
| 4T1 | Breast Ca. (M) | BALB/c; female | Harlan | mammary fat pad | $5.0 \times 10^5$ cells/0.05 mL |
| BxPC3 | Pancreatic Ca. (H) | Ncr nu/nu; female | Taconic | s.c. | $1 \times 10^7/0.1$ mL |
| MatLylu | Prostate Ca. (R) | Ncr nu/nu; male | Taconic | peritibially | $2.0 \times 10^5$ cells/0.04 mL |
| PC3 | Prostate Ca. (H) | Ncr nu/nu; male | Taconic | peritibially | $1 \times 10^6/0.05$ mL |
| DU145 HAS2 | Prostate Ca. (H) | Ncr nu/nu; male | Taconic | peritibially | $5 \times 10^6/0.05$ mL |
| LUM858 | Lung Ca. (H) | BALB/c nude | SLACCAS | s.c. | $3 \times 3 \times 3$ mm$^3$ cube |
| LUM 697 | Lung Ca. (H) | BALB/c nude | SLACCAS | s.c. | $3 \times 3 \times 3$ mm$^3$ cube |
| LUM 330 | Lung Ca. (H) | BALB/c nude | SLACCAS | s.c. | $3 \times 3 \times 3$ mm$^3$ cube |

(H): Human;
(M): Mouse;
(R): Rat

For peritibial tumors, tumor volumes were determined using VisualSonics Vevo 770 high-resolution ultrasound. For subcutaneous and mammary fat pad tumors, tumor volumes were calculated by caliper measurement of the length (L) and width (W) of the solid tumor masses. Tumor volume (TV) was calculated as: $(L \times W^2)/2$. Animals were selected for PEGPH20 treatment when tumor volumes reached ~400-500 mm$^3$. Animals were then randomized into treatment and control groups (n≥6 mice/group).

Treatment with PEGPH20 and analysis of tumor growth inhibition (TGI) were performed as described (Thompson et al.). Mice were treated with vehicle (10 mM Histidine, pH 6.5, 130 mM NaCl) or PEGPH20 for 2-3 weeks according to the schedule shown in Table 7. Tumor volumes were measured twice weekly. When tumor size exceeded 2,000 mm$^3$, animals were removed from the study and humanely euthanized.

TABLE 7

PEGPH20 Treatment and Tumor Growth Inhibition

| Models | PEGPH20 dose (mg/kg) | PEGPH20 amount per 0.1 mL dose (i.v.) | Dosing Frequency | No. of Doses | TGI (day X) | Animal Number |
|---|---|---|---|---|---|---|
| Du145 Mock | 15 | ~10,000 U | twice weekly | 6 | 0.7% (d18) | 8 |

TABLE 7-continued

PEGPH20 Treatment and Tumor Growth Inhibition

| Models | PEGPH20 dose (mg/kg) | PEGPH20 amount per 0.1 mL dose (i.v.) | Dosing Frequency | No. of Doses | TGI (day X) | Animal Number |
|---|---|---|---|---|---|---|
| MDA MB 231 | 4.5 | ~3,000 U | twice weekly | 6 | 0% (d17) | 5 |
| SKOV3 | 5 | ~3,500 U | weekly | 3 | 0% (d14) | 5 |
| MDA MB 231Luc | 4.5 | ~3,000 U | twice weekly | 5 | 23% (d14) | 10 |
| MDA MB 231 Luc/HAS2 | 4.5 | ~3,000 U | twice weekly | 5 | 43% (d14) | 10 |
| AsPc-1 | 4.5 | ~3,000 U | twice weekly | 4 | 18% (d11) | 9 |
| MIA PaCa 2 | 4.5 | ~3,000 U | twice weekly | 4 | 24% (d15) | 9 |
| 4T1 | 3.9 | ~3,000 U | twice weekly | 6 | 61% (d14) | 5 |
| BxPC3 | 4.5 | ~3,000 U | twice weekly | 4 | 45% (d25) | 7 |
| MatLylu | 3.9 | ~3,000 U | q2d | 5 | 34% (d9) | 5 |
| PC3 | 15 | ~10,000 U | twice weekly | 6 | 65% (d18) | 6 |
| DU145 HAS2 | 15 | ~10,000 U | twice weekly | 6 | 50% (d18) | 8 |
| LUM858 (see Ex. 7) | 4.5 | ~3,000 U | twice weekly | 5 | 16% (d14) | 10 |
| LUM 697 (see Ex. 7) | 4.5 | ~3,000 U | twice weekly | 5 | 97% (d14) | 10 |
| LUM 330 (see Ex. 7) | 4.5 | ~3,000 U | twice weekly | 5 | 44% (d16) | 10 |

The TGI for each tumor model was calculated based on the volume from the study termination day as indicated in Table 7. Percent Tumor Growth Inhibition (TGI) for each respective tumor model was calculated using the following equation:

$$\% \text{ TGI} = [1-(T_n-T_0)\div(C_n-C_0)]\times 100\%$$

where "$T_n$" is the average tumor volume for the treatment group (animals receiving PEGylated rHuPH20) at day "n" after the final dose of PEGylated rHuPH20; "$T_0$" is the average tumor volume in that treatment group at day 0, before treatment; "$C_n$" is the average tumor volume for the corresponding control group at day "n"; and "$C_0$" is the average tumor volume in the control group at day 0, before treatment. Statistical analysis of tumor volumes between the control and treatment groups was performed using a one-way ANOVA test with P value of P≤0.05 defined as statistically significant.

2. Histochemistry Staining of HA in Tumor Tissue and Semi-Quantification of HA Content At the termination of the tumor growth inhibition study, each of the fourteen xenograft tumors generated were analyzed for HA content by histochemistry using biotinylated hyaluronan binding protein (B-HABP) as a probe for HA detection and digital quantification.

Tumor tissues were harvested, fixed in 10% neutral buffered formalin solution (NBF), embedded in paraffin, and cut into 5 μm sections. For histochemical analysis, the sections were deparaffinized and rehydrated. Endogenous peroxidases were blocked with peroxo-block solution (Invitrogen, CA, USA) for 2 minutes. Non-specific staining was blocked using 2% BSA in 2% normal goat serum PBS for 1 hour at room temperature (RT) prior to incubation with 2.5 μg/ml biotinylated HA-binding protein (B-HABP, Catalog No. 400763, Seikagaku, Tokyo, Japan) for 1 hour at 37° C. To confirm specificity of staining, a subset of sections were pre-treated with rHuPH20 (1000 U/mL) in PIPES buffer (25 mM PIPES, 70 mM NaCl, 0.1% BSA, pH 5.5) at 37° C. for 1 h before addition of B-HABP. After washing to remove the primary reagent, samples were incubated with streptavidin-horseradish peroxidase solution (BD Pharmingen, Catalog No. 550946) for 30 minutes at RT and detected with 3, 3'-diaminobenzidine (DAB; Dako, Catalog No. K3467). Sections were then counterstained in Gill's hematoxylin (Vector Labs, Catalog No. H-3401), dehydrated and mounted in Cytoseal 60 medium (American MasterTech).

An Aperio T2 Scanscope (Aperio) was used to generate high-resolution images of tissue sections. Images were quantitatively analyzed with Aperio Spectrum software using a pixel count algorithm for brown color (HA) count. The tissue core in the sections with less than 10% of tumor cells or more than 50% of necrotic tissue was excluded for the evaluation. PC3 ($HA^{+3}$) xenograft tumor tissues were used as a positive control. A ratio of strong positive (brown) stain area to the sum of total stained area was calculated and scored as +3, +2, +1, or 0 when the ratio was more than 25%, 10-25%, less than 10%, or 0, respectively.

Spearman's rank correlation coefficient was used to evaluate the relationship between HA expression and response to PEGPH20 treatment.

3. Results: Comparison of Tumor HA Content and Tumor Growth Inhibition Following PEGPH20 Treatment The results presented in Table 8 compare the level of HA measured in tissue sections taken from the xenograft tumor and the percentage tumor growth inhibition (TGI) by PEGPH20. The results are from tumors treated with at least 1 mg/kg PEGPH20. Doses higher than 1 mg/kg did not increase tumor growth inhibition. In the PC-3 ($HA^{+3}$) and BxPC3 ($HA^{+2}$) animal models, no significant increase in efficacy was observed at doses greater than 10 μg/kg and 100 μg/kg, respectively.

Despite the diversity of tumor cell types (human, murine and rat origin), there was a significant correlation (P<0.001, Spearman's r=8, n=14) between increasing B-HABP-mediated HA staining intensity and in vivo antitumor activity of PEGPH20 (Table 8).

TABLE 8

Tumor HA staining intensity and corresponding PEGPH20-mediated growth inhibition.

| Models | Tumor Type (Source) | HA positive Pixels (%) | TGI (%) |
|---|---|---|---|
| DU145 Mock | Prostate Ca. (H) | 3.50 | 0 |
| MDA MB 231 | Breast Ca. (H) | 4.59 | 0 |
| SKOV3 | Ovarian Ca. (H) | 4.87 | 0 |
| MDA MB 231/Luc | Breast Ca. (H) | 6.97 | 23 |
| MDA MB 231/Luc/HAS2 | Breast Ca. (H) | 11.18 | 43 |
| AsPc-1 | Pancreatic Ca. (H) | 15.15 | 18 |
| MIA PaCa 2 | Pancreatic Ca. (H) | 17.08 | 24 |
| LUM330 (see Ex. 7) | Lung Ca. (H) | 17.70 | 44 |
| 4T1 | Breast Ca. (M) | 19.45 | 45 |
| BxPC3 | Pancreatic Ca. (H) | 20.50 | 61 |
| MatLylu | Prostate Ca. (R) | 24.00 | 34 |
| PC3 | Prostate Ca. (H) | 27.27 | 65 |
| DU145 HAS2 | Prostate Ca. (H) | 28.85 | 50 |
| LUM697 (see Ex. 7) | Lung Ca. (H) | 32.73 | 97 |

(H): Human;
(M): Mouse;
(R): Rat

B. Comparison of HA Content with PEGPH20 Efficacy in a Xenograft Tumor Model of HAS2 Overexpression The effect of increasing HA production in a tumor cell on increasing the sensitivity of tumors to treatment with PEGPH20 was further examined in tumor xenografts that express exogenous hyaluronan synthase 2 (HAS2). As shown in Example 5, HA production by the DU-145 tumor cell line could be increased by transduction of the cells with a gene encoding HAS2, which led to enhanced pericellular matrix formation in vitro. Additionally, the DU142-HAS2 displayed increased HA staining and increased tumor inhibition by PEGPH20 in the xenograft models described above. In this Example, the efficacy of PEGPG20 treatment over time was compared in the DU-145 versus DU-145-HAS2 xenografts.

The mouse xenograft models were prepared as described above in Example 6A. Briefly, mice were inoculated with either DU-145/vector controls or DU-145/HAS2 cells as indicated in Table 6. When the tumors reached approximately 500 mm$^3$ in size, the mice were divided into treatment groups (n=8) and treated with vehicle alone or PEGPH20. For the PEGPH20 treatment, the mice were injected via tail vein at a dose of 4.5 mg/kg twice weekly for 3 weeks. Tumor volume was monitored by caliper measurement as described above. The xenograft tumors were analyzed for HA content by histochemistry using biotinylated hyaluronan binding protein (B-HABP) as described above 24 hours after the last treatment with PEGPH20.

The HAS2-overexpressing DU-145 prostate tumor xenograft grew more aggressively in nude mice than the parental cell line transfected with empty vector (DU-145 Mock), similar to previous reports (Table 7) (Thompson et al. (2010)). PEGPH20 inhibited tumor growth in DU-145-HAS2 tumors (TGI=50%, P<0.001, n=8), but not in DU-145 vector control tumors (TGI=0.7%, P>0.05, n=8). In addition, histochemistry staining with B-HABP of PEGPH20-treated tumors showed HA removal in tumor samples compared to control tumors. These data suggest that accumulation of HA in the ECM facilitates tumor development, and that enhanced tumor-associated HA accumulation is associated with the anti-tumor activity of PEGPH20.

C. Dose Related Effects of PEGPH20 Treatment in Hyaluronan-Rich Tumors

In this experiment, the dose dependent effect of PEGPH20 on tumor growth inhibition of HA-rich tumors was examined. Mouse xenograft models were prepared as described above in Example 6A. Briefly, mice were inoculated with either BxPC-3 human pancreatic adenocarcinoma (ATCC CRL-1687) or PC-3 human prostate adenocarcinoma (ATCC CRL-1435) cells according to Table 6. When the tumors reached approximately 500 mm$^3$ in size, the mice were divided into treatment groups (n=10) and treated with vehicle alone or PEGPH20. For the PEGPH20 treatment, the mice were systemically injected tail vein at a dose of 0.01, 0.1, 1, 4.5 and 15 mg/kg (350, 3,500, 35,000, 157,500 and 500,000 U/kg, respectively) twice weekly for 2 weeks. Tumor volume was monitored by caliper measurement as described above.

It was observed that the maximum effective dose of PEGPH20 is below 1 mg/kg. Significant tumor inhibition was observed for all doses of PEGPH20 in the PC-3 xenograft model (P<0.001 for 0.1, 1, 4.5, 15 mg/kg doses; P<0.01 for the 0.01 mg/kg dose compared to vehicle) and for all doses greater than 0.01 in the BxPC-3 xenograft model (P<0.001 for 0.1, 1, 4.5, 15 mg/kg doses compared to vehicle). No significant increase in efficacy was observed at doses greater than 0.01 µg/kg (PC3, HA$^{+3}$) or 0.1 mg/kg (BxPC3, HA$^{+2}$).

D. Effect of PEGylated rHuPH20 on Colony Growth of Hyaluronan-Rich Tumor Cells In Vitro To determine whether PEGPH20 can inhibit anchorage-independent growth and proliferation of hyaluronan-rich prostate tumor cells (PC3) in vitro, a three-dimensional clonogenic assay was performed on cells. PC3 cells, at approximately 80% confluency, were trypsinized, harvested, and washed once in completed medium. Cell density was adjusted to 8×10$^4$/mL cells and suspended in Matrigel® (BD Biosciences, San Jose, Calif.) on ice. 0.025 mL of this cell/Matrigel® mixture were seeded onto a 48 well cell culture plate that had been pre-coated with Matrigel® at 0.1 mL per well, and solidified at 37° C. for 1 hour. For continuous exposure, over 17 days, to control API buffer and various concentrations of PEGPH20, 0.6 mL/well of completed medium containing API buffer, 1, 3, 10 and 100 U/mL of PEGPH20 were added to the top of the appropriate well. The wells were incubated at 37° C., in a humidified atmosphere with 5% $CO_2$ in air for 17 days, fresh treatment medium, including the appropriate concentration of enzyme, where appropriate, was replaced every 3-4 days during the 17 day period.

On day 17, growth of colonies was assessed by capturing images with a Nikon Eclipse TE2000U inverted microscope coupled to an Insight FireWire digital camera (Diagnostic Instruments, Michigan). The colony number and diameter of each colony in µm were measured using ImageJ software (open source software, a publicly available program for display and analysis of images, for calculating area and pixel value) and coupled calibration function (colony volumes were calculated using colony diameter and using the formula: $4/3 \pi r^3$.

Average colony volume of wells for each condition were determined and the effects of PEGPH20 on colony volume assessed by comparing the average colony volume in the control sample (API (active pharmaceutical ingredient) buffer (10 mM Hepes and 130 mM NaCl, pH 7.0) without enzyme) to the samples that were incubated in the presence of PEGylated rHuPH20. Inhibitory ratios were calculated using the formula:

(mean volume of control−mean volume of treated)/
(mean volume of control)*100.

PEGylated rHuPH20 induced a dose-dependent inhibition of growth, evidenced by lower colony volume compared with control. Based on inhibitory ratios calculated using the above formula, the cultures incubated in the presence of PEGPH20 at 1, 3, 10, and 100 U/mL exhibited an average reduction in colony volume of 39%, 67%, 73%, and 75% respectively (p<0.01 for the 3 U and 10 U samples; p<0.001 for the 100 U samples; n=6), compared to cultures incubated with control buffer. Statistical differences were analyzed using the Mann-Whitney Test.

The $IC_{50}$ of PEGPH20 in reducing colony volume, determined using the Graphpad Prism®4 program (GraphPad Software, Inc., La Jolla, Calif.), was approximately 1.67 U/mL. The average number of colonies was 10.17±1.56 per well in vehicle-treated (control) cultures and 11.50±0.89 per well in the cultures treated with PEGPH20 100 U/mL. The difference in colony number was not significant between the control and the 100 U/mL cultures (n=6, p>0.05). These results indicate that PEGPH20 can inhibit proliferation and/or survival of hyaluronan rich cancer cells.

In an independent experiment, PC3 cells were seeded in reconstituted basement membrane (Matrigel) as described above and continuously exposed to vehicle or 0.1, 1, 10, 100, and 1000 U/mL of PEGPH20 for 19 days. Images were then digitally captured and colony volume was assessed using the ImageJ program. Inhibition of colony volume compared to control was 22, 45, 63, 73 and 74%, respectively (P<0.01 for 1 U/ml, P<0.001 for 10 U/mL and above compared to vehicle; n=3).

Example 7

Assessment of HA as a Biomarker for Predicting Response of Human NSCLC Tumors to PEGPH20

A. Expression of HA in NSCLC Patient Biopsies

Previous work has shown that elevated accumulation of HA occurs in non-small cell lung cancer (NSCLC) (Hernández J R, et al. (1995) *Int J Biol Markers* 10: 149-155 and Pirinen R, et al. (2001) *Int J Cancer* 95: 12-17). By contrast, NSCLC-derived cell lines exhibit low levels suggesting the NSCLC cells lines lose HA expression during passaging in vitro. Thus, HA expression in primary tumor biopsies was examined.

A tissue microarray (TMA) panel of 190 NSCLC biopsies (US Biomax, Inc.) were examined for histotype and HA accumulation. HA content was determined by B-HABP histochemistry staining as described in Example 6. Samples were scored as +3, +2, +1 or 0 when the ratio of strong positive (brown) stain area to the sum of total stained area was more than 25%, 10-25%, less than 10% or 0, respectively. In this panel, adenocarcinoma (ADC), squamous cell carcinoma (SCC), and large cell carcinoma (LCC) cell types were observed at frequencies of 32%, 51%, and 3%, respectively, classified based on pathology diagnosis provided by US Biomax (Table 9). Other unidentified subtypes comprised about 11% of the 190 samples examined.

Analysis of tumor-associated HA accumulation showed that all histotypes have subsets of cells which express the $HA^{+3}$ high HA phenotype, with an overall rate of approximately 27% (Table 9). In particular, 40% of SCC cases displayed the $HA^{+3}$ phenotype, while 11% of ADC and 33% of LCC cases were scored as $HA^{+3}$. 34% of SCC cases displayed the $HA^{+2}$ phenotype, while 48% of ADC and 50% of LCC cases were scored as $HA^{+2}$. 25% of SCC cases displayed the $HA^{+1}$ phenotype, while 36% of ADC and 17% of LCC cases were scored as $HA^{+2}$. In this dataset, none of the normal lung tissue samples expressed the $HA^{+3}$ phenotype, although detectable HA was observed in most samples of normal lung tissue.

TABLE 9

Distribution of HA expression in human lung cancer samples

| HA score[1] | ADC[2] | SCC3[2] | LCC[4] | Other | Normal |
|---|---|---|---|---|---|
| | HA positive incidence N (%) | | | | |
| 0 | 3 (4.7) | 0 (0) | 0 (0) | 1 (3) | 0 (0) |
| +1 | 23 (36) | 24 (25) | 1 (17) | 11 (48) | 9 (43) |
| +2 | 31 (48) | 33 (34) | 3 (50) | 9 (39) | 12 (57) |
| +3 | 7 (11) | 40 (41) | 2 (33) | 2 (8.7) | 0 (0) |
| Total | 62 (32) | 99 (52) | 6 (3) | 23 (12) | 21 (100) |

[1]HA scores were defined based on % of positive HA staining intensity
[2]ADC: Adenocarcinoma
[3]SCC: Squamous Cell Carcinoma
[4]LCC: Large Cell Carcinoma B. Expression of HA in NSCLC Patient Explants and Prediction of PEGPH20 Efficacy In order to prospectively test the relationship between HA overexpression and antitumor response of NSCLC to PEGPH20-mediated HA depletion, human NSCLC patient tumor explants representing different degrees of HA accumulation were selected and assessed for responsiveness to PEGPH20 treatment in a xenograft tumor model. Primary explants characterized for HA accumulation were used for this study because explant models contain a more representative sampling of the genetic diversity of intact tumors, and should retain aspects of native tumor-like stroma.

Tumor biopsies were obtained from sixteen NSCLC patients, and were maintained at a low passage number subcutaneously in nude mice (Crown Bioscience, Beijing, China). The NSCLC tumor explants were screened for HA accumulation in explant tissues from passages 1-4 and were assigned an HA phenotype (i.e., +1, +2 or +3) by B-HABP histochemistry staining as described above. Three squamous cell-type (SCC) explants were prospectively selected for xenograft transplantation, representing the $HA^{+3}$ (LUM697), $HA^{+2}$ (LUM330), and $HA^{+1}$ (LUM858) phenotypes.

When the seed tumors for the selected tumor explants reached 500-700 $mm^3$ in size, the mice were sacrificed and the tumors were extracted and minced into 3×3×3 $mm^3$ fragments. One fragment for each tumor was subcutaneously implanted into the right rear flank of a female Balb/c nude mouse (n=10 for each group) as indicated in Table 6. Tumor volumes were determined by caliper measurements of the greatest longitudinal diameter (length (L)) and the greatest transverse diameter (width (W)) and estimated using the calculation of $(L \times W^2)/2$. When the average tumor size reached 500 $mm^3$ (range 300-600 $mm^3$), the animals were randomized into two groups. For therapy, animals were treated with vehicle or PEGPH20 at 4.5 mg/kg twice weekly for 5 doses as shown in Table 7 above. The percentage tumor growth inhibition (% TGI) and statistical analysis were performed as described Example 6.

The rank-order of HA phenotype (i.e., +1, +2 or +3) as determined by histochemistry was found to predict the degree of tumor growth inhibition by PEGPH20 (Table 9). For example, the percentage growth inhibition was 97% for LUM697 ($HA^{+3}$), 44% for LUM330 ($HA^{+2}$), and 16% for LUM858 ($HA^{+1}$). In addition, tumor regression was observed in the LUM697 ($HA^{+3}$) tumor explant group, but not the LUM330 ($HA^{+2}$) and LUM858 ($HA^{+1}$) groups: 4 of 10 animals with LUM697 ($HA^{+3}$) tumors had decreased tumor burden compared to pretherapy.

Example 8

Effect of PEGPH20 Treatment on Xenograft Tumor Cell DNA Synthesis and the Tumor Microenvironment (TME)

A. Effect of HA Depletion on Tumor Cell DNA Synthesis

To test whether HA depletion has antiproliferative effects on tumor cells in vivo, PC-3 ($HA^{+3}$) tumor xenografts treated with PEGPH20 were examined for levels of DNA synthesis.

Six to eight week old nu/nu (Ncr) athymic nude mice intraperitibially implanted with PC-3 tumor cells as described in Example 6 ($1 \times 10^6$ cell in 0.05 mL per mouse). Tumor volume was monitored by caliper measurement. When the tumors reached ~400 $mm^3$, the mice were treated with vehicle or PEGPH20 (1 mg/kg (35,000 U/kg) or 4.5 mg/kg (157,500 U/kg); about 700 U/dose or 3150 U/dose based on 20 g mouse body weight), 100 μL via tail vein injection twice weekly for two weeks. The 24 hours before study termination, the mice were administered 10 mg/kg BrdU (0.2 mL) (Invitrogen, Cat#00-0103) intraperitoneally. Tumors were excised from the mice, fixed in 10% buffered formalin and embedded in paraffin. Tissues were cut into 5 μm sections, and cell proliferation was assessed after staining with an anti-BrdU antibody (BrdU Staining Kit; Invitrogen, Cat#93-3943) according to the manufacturer's instructions.

Animals treated with PEGPH20 were compared to vehicle-treated animals. A 58.3% reduction in synthetically active nuclei was observed in the PEGPH20 treated tumors compared to vehicle-treated tumors (percent BrdU positive nuclei was reduced from 4.8% to 2%). This result parallels the observed growth inhibition of prostate PC3 (HA$^{+3}$) or pancreatic BxPC3 (HA$^{+2}$) xenografts as a result of PEGPH20 treatment (~50% TGI at doses of 1 mg per kg or more) (see Example 6).

B. Effect of HA Depletion on Expression of Tumor Microenvironment Associated Proteins Previous studies have shown that treatment of HA$^{+3}$ tumors with PEGPH20 has a dramatic effect on tumor interstitial fluid pressure (IFP), and therefore on the fluid pressure differential between the tumor and its external environment (see Thompson et al. (2010)). Physical changes in the TME can have an impact gene expression (Shieh A C (2011) *Ann Biomed Eng* 39:1379-1389). In order to test whether removal of HA has an impact on turnover or expression of TME proteins, expression of TME proteins, such as murine collagen I (Col1α1), murine collagen V (Col5α1), and tenascin C (TNC), which are found in the actively remodeling matrix, were examined.

1. Localization and Semi-Quantification of Collagen in Tumor Tissue

Tumor tissues with adjacent skin from PC-3 tumors generated in Example 8A were fixed in 10% neutral buffered formalin for 48 hours, processed using a tissue processor (TISSUE-TEKVIP, Sakura Finetek, CA) and embedded in paraffin block. The paraffin-embedded tissue samples were cut into 5 μm sections, dewaxed, and rehydrated in deionized water. Antigen retrieval was processed by heating slides in EDTA buffer at pH 8.0, 100° C. for 25 min. Slides were rinsed in PBS-T, blocked with 2% normal goat serum in 2% PBS/BSA for 30 min, followed by incubation with rabbit polyclonal anti-collagen type 1 antibody (1:200, Abcam, Cat#ab34710) for 2 hours at room temperature. The sections were then incubated in Texas red tagged goat anti-rabbit IgG (1:200, Vector Laboratories, Cat# F1-1000) for 1 hour at room temperature, and counter stained and mounted with ProLong® Gold antifade reagent with DAPI (Invitrogen, CA). Micrographs were captured under a Zeiss Axioskop microscope coupled with RT3 camera (Diagnostic Instruments, MI). Random 5 fields from each section were analyzed for collagen-positive intensity using Image-Pro plus program.

2. cDNA Arrays Analysis of Gene Expression in PC3 Xenograft Tumor Tissue

NCR nu/nu mice bearing PC3 tumors were generated and treated with vehicle or PEGPH20 as described in Example 6A. Animals were euthanized 8 and 48 hours post-treatment with vehicle or PEGPH20. Tumor tissues were excised in sterile conditions and snap frozen in liquid nitrogen. Total RNA was isolated from frozen tissue according to Asuragen's standard operating procedures. The purity and quantity of total RNA samples were determined by absorbance readings at 260 and 280 nm using a NanoDrop ND-1000 UV spectrophotometer. The integrity of total RNA was qualified by Agilent Bioanalyzer 2100 microfluidic electrophoresis. Samples for mRNA profiling studies were processed by Asuragen, Inc. using Affymetrix Mouse 430 2.0 and Human U133 plus 2.0 arrays.

3. Results

Tumor-specific reduction of Col1α1 in the PC-3 tumors was observed following depletion of HA by treatment with PEGPH20. 80% reduction in Col1α1 staining compared to vehicle treated tumors was observed (P<0.05 t test). Col1α1 staining in skin from PEGPH20 treated mice, however, remained stable. In addition, decreased levels of murine (stromal) mRNAs for Col1α1, Col5α1, and TNC were observed as measured by mRNA expression array analysis. TNC mRNA was most significantly impacted (66% decrease), followed by Col1α1(53% decrease) and Col5α1 (45% decrease). These results suggest that depletion of HA results in significant changes in the expression of proteins within the TME.

Example 9

Generation of TSG-6 Link Module IgG Fc Fusion Protein

A fusion protein, TSG-6-LM-Fc, containing the link module of TSG-6 and the Fc domain of IgG was generated. A mutant fusion protein TSG-6-LM-Fc/ΔHep in which the heparin binding region of the TSG-6 link module was mutated, also was generated.

A. Vector Construction of Recombinant Human TSG-6 Link Module Fusion Proteins

DNA de novo synthesis (GenScript, NJ) was employed to generate nucleic acid encoding the TSG-6-LM-Fc fusion protein. The nucleic acid contains a DNA encoding a human immunoglobulin light chain kappa (κ) leader signal peptide sequence (SEQ ID NO:210), a 669 bp-long cDNA fragment of human IgG1 heavy chain (GI No. 5031409; SEQ ID NO: 203, encoding the peptide sequence set forth in SEQ ID NO:204) and a 285 bp-long cDNA fragment of human TSG-6 link module region (SEQ ID NO:216, encoding the peptide sequence set forth in SEQ ID NO:207, which corresponds to amino acid positions 35 to 129 of the TSG-6 preprotein, GI No. 315139000, set forth in SEQ ID NO:205 (mRNA) and SEQ ID NO:206 (protein)). The human IgG1 heavy chain and human TSG-6 link module regions were connected with a 6 bp AgeI restriction enzyme cleavage site and a 12 bp sequence, GACAAAACTCAC (SEQ ID NO: 208), encoding four additional amino acids (DKTH; SEQ ID NO: 209) originally published as part of the IgG1 Fc sequence (*Nucleic Acids Research,* 1982, Vol. 10, p4041). Two unique restriction enzyme cleavage sites, NheI at 5' end and BamHI at 3' end, were synthesized flanking the fusion protein sequence. The synthesized fragment has a sequence set forth in SEQ ID NO:217. The fragment was codon optimized for improved protein expression and synthesized by de novo DNA synthesis. The codon optimized fragment has a sequence set forth in SEQ ID NO:211. The protein sequence for the encoded TSG-6-LM-Fc fusion protein is set forth in SEQ ID NO: 212.

The synthesized codon optimized fragment was inserted via NheI and BamHI cleavage sites into the pHZ24 IRES bicistronic mammalian expression vector (SEQ ID NO: 52) using well-known recombinant DNA procedures (restriction enzyme and ligation reagents obtained from New England Biolabs, Ipswich, Mass.) to generate pHZ24-TSG-6-LM-Fc construct (SEQ ID NO:213). Recombinant protein expression in this vector is driven by a CMV promoter.

In order to enhance the hyaluronan (HA) binding specificity and reduce binding to other GAG chains, a construct encoding a mutant fusion protein, TSG-6-LM-Fc/ΔHep, that contains 3 lysine to alanine mutations at amino acid positions 55, 69, 76 of the TSG-6 link module was constructed. The mutations reduce the heparin binding activity of the TSG-6 link module, while not affecting the HA binding activity (see Mahoney D J et al. (2005) *J Biol. Chem.* 280:27044-27055, which reports 10-fold lower heparin binding activity for the triple mutant; K20A/K34A/K41A in the heparin binding site). TSG-6-LM-Fc/ΔHep was generated by mutagenesis of the nucleic acid fragment encoding the TSG-6-LM-Fc fusion protein and insertion into the pHZ24 IRES vector to generate pHZ24-TSG-6-LM-Fc/ΔHep (SEQ ID NO:218). The sequence of the TSG-6-LM-Fc/ΔHep fragment is set forth in SEQ ID NO: 214, which encodes the TSG-6-LM-Fc/ΔHep fusion protein set forth in SEQ ID NO: 215.

B. Recombinant Protein Expression and Purification

FreeStyle CHO-S suspension cells (Invitrogen) were employed for expression of TSG-6-LM-Fc and TSG-6-LM-Fc/ΔHep fusion proteins. The FreeStyle CHO-S suspension cell line was maintained in CHO-S CD culture medium (Invitrogen) prior to transfection. For preparation of the cells for transfection and recombinant protein expression, FreeStyle CHO-S cells were cultured in FreeStyle CHO Expression Medium (Invitrogen) supplemented with 8 mM L-glutamine in shake flasks at 37° C. in a humidified atmosphere of 8% CO2 in air on an orbital shaker platform rotating at 125 rpm with loosened caps of flasks to allow for aeration.

Transient transfection of suspension cells was performed according to the manufacturer's instructions. Briefly, cells were split at a density $6 \times 10^5$/ml 24 hours before transfection, and transfected using FreeStyle Max lipid with a DNA/lipid ratio at 1:1. After 96 hours post-transfection, cells were harvested at 4,000 g for 20 min, and supernatants were collected. A time course analysis of protein expression level during the post-transient transfection revealed that the protein expression level reached a plateau after 96 hours post transfection. Thus, the recombinant protein was collected at 96 hour post-transfection.

The expressed TSG-6-LM-Fc and TSG-6-LM-Fc/ΔHep fusion proteins in the collected supernatants were affinity purified by Protein A resins (Bio-Rad, Hercules, Calif.) according to the manufacturer's instructions. Briefly, the collected supernatants were adjusted to pH 7.4, 0.15 M NaCl with 1 M Tris-HCl, pH 7.4 (Teknova Catalog No. T1074) and 5M NaCl (Sigma) and diluted with binding buffer 3 fold before loaded onto a Protein A column. The eluted product was immediately neutralized with 1M Tris-HCl, pH 8.5, and dialyzed against Phosphate-Balanced Solution (PBS, 137 mM NaCl, 2.7 mM KCl, 8 mM $Na_2HPO_4$, 1.46 mM $KH_2PO_4$, and pH 7.4) at 4° C., and stored at −20° C. The yield of the purified proteins from the supernatants through a single step Protein A affinity column was between 3 to 5 mg/liter.

C. SDS-PAGE and Western Blot Analysis of Expressed Recombinant Proteins

The purity, size and identity of the purified fusion protein were determined by SDS-PAGE 4-20% gradient gel under reducing and non-reducing conditions and Western Blot analysis. 60 ng of purified protein was used in the analysis. The size of the purified fusion proteins were about 40 kDa under reducing conditions and about 80 kDa under non-reducing conditions, indicating the expressed proteins form homodimers via disulfide bonds in hinge region of IgG Fc. The purity of the protein samples were greater than 95%. The purified proteins were stable in PBS for at least one month at 4° C. without any visible degradation or loss of binding activity.

The identity of the TSG-6 link module in TSG-6-LM-Fc and TSG-6-LM-Fc/ΔHep was assessed by Western blot with goat anti-human TSG-6 IgG (R&D Systems, Inc., Minneapolis, Minn.) followed by rabbit anti-goat IgG-HRP (EMD, San Diego, Calif.). Recombinant full length human TSG-6 protein (R&D Systems, Inc., Minneapolis, Minn.) was employed as a positive control. The pattern of detected proteins by Western blot analysis under reducing and non-reducing conditions was the same as that of SDS-PAGE analysis except for a small amount of upper bands observed under the non-reducing condition, most likely representing tetramers of the recombinant proteins based on their molecular weight size.

The identity of the Fc portion in the purified recombinant proteins was confirmed by Western blot analysis with HRP-rabbit anti-human IgGFc (Jackson ImmunoResearch, West Grove, Pa.). The pattern of detected proteins was the same as for the SDS-Page and anti-TSG-6 analyses, indicating that the purified proteins contain both TSG-6 link module (LM) as well as hIgGFc.

To analyze whether the proteins were glycosylated, the purified proteins were treated with glycosidase PNGase F (0.5 units per ng protein), which removes the N-linked oligosaccharides from proteins, and analyzed by SDS-PAGE and Western blot. A 5 kDa difference of molecular weights of proteins was observed between before and after treatment with PNGase F, indicating that the expressed proteins were glycosylated.

Example 10

Binding of TSG-6 to Hyaluronan and Heparin

Two formats were used to test the binding of both TSG-6-LM-Fc and its mutant to HA and heparin. In one format, binding of TSG-6-LM-Fc and TSG-6-LM-Fc/ΔHep to immobilized HA or Heparin on a microplate was employed. In the second format, binding of biotinylated HA and heparin to immobilized recombinant TSG-6-LM-Fc and TSG-6-LM-Fc/ΔHep proteins on a microplate was employed.

A. Binding of Recombinant TSG-6-LM-Fc and TSG-6-LM-Fc/ΔHep to Immobilized HA and Heparin Wild type and mutant TSG-6-LM Fc fusion homodimers were tested for their HA binding and heparin binding activities using either HA or heparin-coated microplates. Briefly, hyaluronan with an average MW of about 1000 kDa (Lifecore, Chaska, Minn.) or Heparin with an average MW of 15 kDa (Calbiochem, San Diego, Calif.) at concentration of 100 µg/ml in 0.5 M sodium carbonate buffer, pH 9.6, was dispensed into 96-well plates in duplicate, 100 µl/well, and incubated at 4° C. overnight. Plates were blocked with 1% BSA in PBS to reduce non-specific binding.

TSG-6-LM-Fc and TSG-6-LM-Fc/ΔHep purified protein samples were diluted to give rise to a concentration range from 0.31 to 40 ng/ml for binding to HA coated plate, 0.78 to 100 ng/ml for binding to heparin coated plate. For each sample, 100 µl per well in duplicate was added to the microplate and incubated at room temperature for 1 hour. Plates were washed PBS with 0.05% Tween 20, 5 times to remove unbound protein. Hyaluronan or heparin bound TSG-6-LM-Fc and TSG-6-LM-Fc/ΔHep were detected with rabbit anti-human IgG Fc-HRP (Jackson ImmunoResearch, West Grove, Pa.) followed by TMB (3,3',5,5'-tetramethylbenzidine) substrate (KPL, Gaithersburg, Md.). The samples were incubated 60 minutes with the rabbit anti-human IgG Fc-HRP antibody. After washing, bound HRP was detected with TMB solution over 10-15 minutes development time followed by addition of phosphoric acid reagent to stop color development. Absorbance was measured at OD450 using a Molecular Devices, Spectra M3 spectrophotometer.

Both TSG-6-LM-Fc and TSG-6-LM-Fc/ΔHep displayed the same HA binding activity on the HA coated plate; and their titration curves of HA binding activity were almost overlapped, indicating that the two expressed proteins bind HA with high affinity based on the $EC_{50}$ values from titration curves of HA binding. The triple mutation in the heparin binding site has no effect on its HA binding. In contrast, the binding of the two proteins to the heparin coated plate showed a significant difference. The wild type TSG-6-LM-Fc bound heparin although with relatively low binding activity compared to its binding to HA, which could be due to the size difference of the two GAG chains coated on the plates. The mutant TSG-6-LM-Fc protein exhibited about 10% of heparin binding activity compared to that of wild type, which was consistent with the reported result for the triple-mutated TSG-6-LM monomer (Mahoney D J et al. (2005).

B. Binding of Biotinylated HA and Heparin to Immobilized Recombinant TSG-6-LM-Fc and TSG-6-LM-Fc/ΔHep The GAG binding properties of wild type TGS6-LM-Fc and TSG-6-LM-Fc/ΔHep were further examined by coating microplates with the recombinant proteins and assessing their binding to biotinylated HA and biotinylated heparin.

For preparation of the microplates, TSG-6-LM-Fc and TSG-6-LM-Fc/ΔHep at a concentration of 2 µg/ml in 1×PBS buffer was dispensed into 96-well plates in duplicates, 100 µl/well, and incubated at 4° C. overnight. Plates were blocked with 1% BSA in PBS to reduce non-specific binding.

TSG-6-LM-Fc and TSG-6-LM-Fc/ΔHep purified protein samples were diluted to give rise to concentration range from 0.31 to 40 ng/ml for binding to HA coated plate, 0.78 to 100 ng/ml for binding to heparin coated plate. 100 µl per well for each sample in duplicate was added to the microplate and incubated at room temperature for 1 hour. Hyaluronan or heparin bound TSG-6-LM-Fc and TSG-6-LM-Fc/ΔHep were detected with anti-human IgG Fc-HRP (Jackson ImmunoResearch, West Grove, Pa.) followed by TMB (3,3',5,5'-tetramethylbenzidine) substrate (KPL, Gaithersburg, Md.).

For biotinylation of HA, the carboxyl groups on HA were used for the conjugation via hydrazide chemistry. Briefly, biotin-hydrazide was dissolved in DMSO at a concentration of 25 mM, and added at a volume ratio of 6:100 into an HA solution, containing 1000 kDa or 150 kDa molecular weight HA (Lifecore Biomedical, LLC Chaska, Minn.) at 1 mg/ml in 0.1 M MES, pH 5.0. 1-Ethyl-3-[3-dimethylaminopropyl]carbodiimide hydrochloride (ECD) and sulfo-N-Hydroxysuccinimide (sulfo-NHS) were added in the conjugation reaction to a concentration of 40 µM and 850 µM, respectively, to mediate the conjugation of biotin-hydrazide and HA. The reaction was kept at 4° C. overnight while stirring. The excess amount of chemicals was removed from biotinylated HA by dialysis. Biotinylated heparin was purchased from EMD, San Diego (Catalog No. 375054).

Biotinylated hyaluronan or heparin were diluted in PBS with concentration range from 0.78 ng/ml to 100 ng/ml, dispensed 100 µl/well, and incubated at room temperature for 1 hour. Plates were washed with PBS with 0.05% Tween 20, 5 times to remove unbound protein. The bound biotinylated hyaluronan and heparin were detected with anti-Streptavidin-HRP (Jackson ImmunoResearch, West Grove, Pa.) followed by TMB substrate (3,3',5,5'-tetramethylbenzidine) substrate (KPL, Gaithersburg, Md.) as described above. Absorbance was measured at OD450.

The binding results observed were similar to the binding assay performed in Example 10A, which used immobilized HA and heparin and free TSG-6-LM-Fc and TSG-6-LM-Fc/ΔHep. There was no difference of binding activity of immobilized TSG-6-LM-Fc and TSG-6-LM-Fc/ΔHep to biotinylated HA or in the binding titration curves between TSG-6-LM-Fc and TSG-6-LM-Fc/ΔHep, and a significant reduction in the binding of mutant TSG-6-LM-Fc/ΔHep to biotinylated heparin compared to that of wild type protein also was observed. Therefore, the HA and heparin binding properties of wild type TSG-6-LM-Fc and its mutant can be evaluated in either GAG coated or recombinant protein coated format; and both formats revealed similar binding patterns.

C. Calculation of Binding Affinity of TSG-6-LM-Fc

The HA binding affinity of TSG-6-LM-Fc was measured using Bio-Layer Interferometry (BLI) technology via Octet QKe instrument (ForteBio, Menlo Park, Calif.). The full length TSG-6 recombinant protein (R&D Systems, Inc., Minneapolis, Minn.) was used as control. Briefly, biotinylated HA with an average molecular weight of 150 kDa was immobilized on streptavidin coated biosensors for 240 seconds. TSG-6-LM-Fc and TSG-6-LM-Fc/ΔHep was then associated with immobilized HA for 180 seconds at different concentrations in PBS at pH 6.0 or pH 7.4, followed by dissociation of bound proteins in PBS at pH 6.0 or pH 7.4 for 240 seconds. The results of binding kinetics were analyzed by the software provided by the manufacturer. Results for the calculated binding affinity are provided in Table 10.

TABLE 10

Binding Affinity of TSG-6-LM-Fc

| Sample ID | Conc. (nM) | pH | KD (M) | kon(1/Ms) | kdis(1/s) | Full R^2 |
|---|---|---|---|---|---|---|
| TSG-6-LM-Fc | 18.8 | 6.0 | 5.45E−09 | 2.46E+05 | 1.34E−03 | 0.970616 |
| TSG-6-LM-Fc | 6.25 | 6.0 | 5.45E−09 | 2.46E+05 | 1.34E−03 | 0.970616 |
| TSG-6-LM-Fc | 18.8 | 7.4 | 1.41E−08 | 4.44E+04 | 6.24E−04 | 0.986378 |
| TSG-6-LM-Fc | 6.25 | 7.4 | 1.41E−08 | 4.44E+04 | 6.24E−04 | 0.986378 |

Example 11

Competitive Inhibition Assessment of TSG-6 Binding to Hyaluronan and Heparin by Other Glycosaminoglycans The HA and heparin GAG binding sites of the TSG-6 link module are located at different regions of the link module. In order to determine whether the two binding sites would interfere with each other during the interaction with TSG-6 link module or in the presence of other GAG chains, a competitive inhibition assay was performed to assess binding of HA or heparin in the presence of other GAG chains.

HA and heparin coated 96-well microplates were prepared as described in Example 10A. TSG-6-LM-Fc and TSG-6-LM-Fc/ΔHep, at a concentration of 40 ng/ml for the HA coated plates and 100 ng/ml for the Heparin coated plates, were pre-incubated with four different GAG chains: HA (Lifecore Biomedical, LLC Chaska, Minn.), chondroitin sulfate A (EMD, San Diego, Calif., Catalog No. 230687) chondroitin sulfate C (EMD, San Diego, Calif., Catalog No. 2307) and heparin sulfate (EMD, San Diego, Calif., Catalog No. 375095), at three different concentrations (0.11, 0.33, 1.0 µg/ml) or without GAG chain as control at room temperature for 10 minutes. The samples were then dispensed (100 µl) in duplicate into the HA and heparin coated 96-well microplates and incubated at room temperature for 1 hour. Plates were washed with PBS with 0.05% Tween 20, 5 times, to remove unbound protein. Bound TSG-6-LM-Fc and TSG-6-LM-Fc/ΔHep were detected with anti-human IgG Fc-HRP (Jackson ImmunoResearch, West Grove, Pa.) followed by TMB (3,3',5,5'-tetramethylbenzidine) substrate (KPL, Gaithersburg, Md.) as described above. Absorbance was measured at OD450.

For the HA coated plate, both TSG-6-LM-Fc and TSG-6-LM-Fc/ΔHep revealed similar competitive inhibition patterns. Binding of TSG-6-LM-Fc to the immobilized HA was efficiently inhibited by pre-incubation of same amount of protein with the different doses of free HA (approximately 68%, 85%, and 93% inhibition for the 0.11, 0.33, 1.0 µg/ml doses, respectively), but was not affected by pre-incubation with different doses of free heparin or chondroitin sulfate C. Some inhibition of TSG-6-LM-Fc and TSG-6-LM-Fc/ΔHep was observed for pre-incubation with chondroitin sulfate A, though it was less than for HA (approximately 23%, 43%, and 63% inhibition for the 0.11, 0.33, 1.0 µg/ml doses). Thus, an approximately 10 fold higher amount of chondroitin sulfate A was needed for inhibition. (In independent experiments up to 30-fold higher amount of chondroitin sulfate A was needed for inhibition compared to HA). Because TSG-6-LM-Fc and TSG-6-LM-Fc/ΔHep showed similar inhibition with pre-incubation with chondroitin sulfate A, it is likely that the HA binding site in TSG-6 link module is responsible for the chondroitin sulfate A binding.

For the heparin coated plates, the binding of TSG-6-LM-Fc to heparin was efficiently inhibited not only by pre-incubation with heparin, but also by pre-incubation with either HA or chondroitin sulfate A. This data shows that the binding of TSG-6-Fc-LM to HA could block its heparin binding activity. As expected, mutant TSG-6-LM-Fc/ΔHep did not bind heparin and thus exhibited readings close to background for both control and pre-incubation samples.

This study demonstrates that binding of link module of TSG-6 to HA is not affected by the presence of free heparin or preformed TSG-6 heparin complex, while its binding to heparin is significantly inhibited by the presence of free HA or preformed TSG-6 HA. Based on these observations, one can conclude that TSG-6-LM binds to HA and heparin simultaneously or binding of TSG-6-LM to HA is stronger than its binding to heparin. HA and TSG-6-LM complex formation can cause protein conformation change or other arrangements of the protein that are not favorable for its binding to heparin.

Example 12

Comparison of Glycosaminoglycan Binding Properties of TSG-6-LM-Fc, TSG-6-LM-Fc/ΔHep and HABP In this example, the specificity and binding activity of TSG-6-LM-Fc, TSG-6-LM-Fc/ΔHep and HA binding protein (HABP) to HA, heparin, and other GAGs were compared. For this experiment, biotinylated-TSG-6-LM-Fc and biotinylated-TSG-6-LM-Fc/ΔHep HA binding proteins were generated and compared to commercially available biotinylated-HA binding protein (HABP) (Seikagaku, Tokyo, Japan) for their binding activity on GAG chain coated plates.

A. Biotinylation of TSG-6-LM-Fc and TSG-6-LM-Fc/ΔHep

A random labeling approach was used to conjugate the biotin to primary amine containing residues (Lys) in the protein directly without pre-incubation with free HA in order to protect HA binding sites. For biotinylation of TSG-6-LM-Fc and TSG-6-LM-Fc/ΔHep, direct conjugation of the primary amine active reagent NHS-PEG$_4$-Biotin (Thermo Fisher Scientific, Chicago, Ill.) was performed according to the manufacturer's instructions. 0.5 mg protein in PBS at concentration 1 mg/ml and 10 µl of 20 mM biotinylation reagent was used for the biotinylation reaction. The N-hydroxysuccinimide ester (NHS) group of NHS-PEG$_4$-Biotin reacts specifically and efficiently with lysine and N-terminal amino groups at pH 7-9 to form stable amide bonds. The hydrophilic polyethylene glycol (PEG) spacer arm imparts water solubility that is transferred to the biotinylated molecule, thus reducing aggregation of labeled proteins stored in solution. The PEG spacer arm also gives the reagent a long and flexible connection to minimize steric hindrance involved with binding to avidin molecules. Unreacted NHS-PEG$_4$-Biotin was removed with dialysis against 1×PBS and stored at −20° C.

For comparison, the TSG-6-LM-Fc and TSG-6-LM-Fc/ΔHep proteins also were biotinylated using the oriented labeling approach, which conjugates the biotin units to sugar chains on the proteins by oxidation of polysaccharide chain on the protein using NaIO$_4$ followed by biotin-hydrazide. Briefly, 1 ml protein at a concentration of 1 mg/ml in 0.1 M phosphate buffer, pH 7.2, was first oxidized by sodium periodate (NaIO$_4$) at a final concentration of 5 mg/ml, at 4° C. for 30 minutes. The reaction converts the two adjacent primary hydroxyl groups on sugars to corresponding aldehyde reactive groups. The oxidized protein was dialyzed against 0.1 M phosphate buffer, pH 7.2. The dialyzed protein was then mixed with 50 mM hydrazide-biotin prepared in DMSO at volume ratio 9 to 1 resulting in 5 mM hydrazide-biotin in the reaction and incubated at room temperature for 2 hours to form hydrazone bonds between aldehyde groups and hydrazide groups. The labeled protein was dialyzed against 1×PBS and stored at −20° C.

After conjugation and removal of free biotin, the HA binding activity of both biotin-TSG-6-LM-Fc and biotin-TSG-6-LM-Fc/ΔHep were tested together with non labeled corresponding proteins to examine if the labeling would cause reduced HA binding activity using the binding assay as described in Example 10A using HA coated plates. No difference in HA binding activity was found between labeled vs non labeled proteins.

B. Binding of Biotinylated-TSG-6-LM-Fc, Biotinylated-TSG-6-LM-Fc/ΔHep and Biotinylated-HABP to GAGs For preparation of the GAG coated microplates, HA, Heparin, chondroitin sulfate A, or chondroitin sulfate C, at a concentration of 100 µg/ml in 0.5 M sodium carbonate buffer, were dispensed, 100 µl/well, into 96-well plates in duplicate, and incubated at 4° C. overnight. Plates were blocked with 1% BSA in PBS to reduce non-specific binding. The three biotinylated proteins, biotinylated-TSG-6-LM-Fc, biotinylated-TSG-6-LM-Fc/ΔHep and biotinylated-HABP were diluted to concentrations ranging from 0.05 to 100 ng/ml for binding to HA, chondroitin sulfate A, and chondroitin sulfate C coated plates, and 0.23 to 500 ng/ml for binding to heparin coated plates. The diluted protein samples were dispensed onto the plates, 100 µl/well in duplicate, and incubated at room temperature for 1 hour. The proteins bound to the GAG coated plates were detected with Streptavidin-HRP (Jackson ImmunoResearch, West Grove, Pa.) followed by TMB (3,3', 5,5'-tetramethylbenzidine) substrate (KPL, Gaithersburg, Md.) as described above. Absorbance was measured at OD450.

All three biotinylated GAG binding proteins exhibited strong HA binding activity on the HA coated plate. At 11.1 ng/ml protein concentration, which represented one dilution lower than maximal binding concentrations (i.e. 33.3 ng/ml and 100 ng/ml) for HA, binding of biotinylated-TSG-6-LM-Fc and biotinylated-TSG-6-LM-Fc/ΔHep to HA was approximately 14 fold over background, and B-HABP binding to HA was approximately 9 fold over background.

Both biotinylated-HABP and biotinylated-TSG-6-LM-Fc/ΔHep displayed little binding activity against the heparin coated plate. Biotinylated-wild type TSG-6-LM-Fc also showed negative in heparin binding activity, suggesting that the random labeling approach with NHS-PEG$_4$-Biotin caused a loss of heparin binding activity. When TSG-6-LM-Fc was biotinylated by the oriented labeling approach as described above, binding to heparin was restored and the protein exhibited similar heparin binding activity as that of non-labeled TSG-6-LM-Fc. Thus, biotin modification of lysines in heparin site of TSG-6-LM-Fc should abolish its heparin binding activity.

All three proteins exhibited no binding activity to chondroitin sulfate C coated plate, but demonstrated strong binding towards chondroitin sulfate A coated plate. The biotinylated-TSG-6-LM-Fc and biotin-TSG-6-LM-Fc/ΔHep were observed to exhibit a few fold higher binding activity than that of biotin-HABP. At 11.1 ng/ml protein concentration, binding of biotinylated-TSG-6-LM-Fc and biotinylated-TSG-6-LM-Fc/ΔHep to HA was approximately 20 fold and 12 fold over background, respectively and B-HABP binding to HA was approximately 6 fold over background. Nonetheless, both TSG-6-LM-Fc and TSG-6-LM-Fc/ΔHep have much stronger preference for binding to HA as demonstrated in the GAG competitive assay. As shown in Example 11, at least 10 fold more of chondroitin sulfate A was needed to reach the similar competitive inhibition as HA. In addition, in a separate experiment, biotinylated-HABP was compared to biotinylated-TSG-6-LM-Fc in a GAG competitive assay, and similar inhibition patterns of four GAG chains (HA, Heparin Chondroitin sulfates A & C) to the binding of biotin-HABP to HA versus the binding of TSG-6-LM-Fc to HA were observed.

Example 13

Quantitation of Hyaluronan in $K_3$-EDTA Human Plasma by Aggrecan Binding Assay

The concentration of hyaluronan was determined in clinical human plasma samples using a sandwich binding assay. Plasma samples were obtained from 19 subjects with solid tumor and various tumor types at advanced stage that were enrolled in a clinical study (Phase 1-101 and Phase 1-102; see Table 11) assessing escalating dosage of PEGPH20 in patients in the presence or absence of dexamethasone. In addition, plasma samples also were obtained from twenty (20) normal patients (obtained from BioReclamation, Hicksville, N.Y.). Prior to treatment with PEGPH20, baseline levels of HA were determined as follows.

Immulon 4HBX 96-well flat bottom microtiter plates (Immulon/Thermo; Catalog No. 3855) were coated with a recombinant human aggrecan (rHu-aggrecan) R & D Systems, Catalog No. 842162) as capture reagent. Prior to use, the rHu-aggrecan was reconstituted by adding 250 µl of reagent diluent to 1 vial and stored at 2-8° C. for up to 1 month. Then, to generate a 0.5 µg/mL solution of rHu-aggrecan, a 240-fold dilution of the stock was prepared (e.g. 41.7 µL stock to about 10 mL PBS). Immediately after dilution, 100 µL was dispensed into each well of a 4HBX plate and the plate was covered with a plate sealer and incubated overnight or up to 3 days at room temperature. After incubation, each well in the plate was washed five (5) times with 1×PBST wash buffer (1×PBS, 0.05% Tween 20) using the ELx405Select CW plate washer. The assay plate was then blocked with block buffer (5% Tween 20 in PBS) by adding 300 µL of block buffer to each well. The plate was covered with an adhesive plate cover and incubated at ambient temperature for at least 1 hour without shaking.

Prior to incubating the plate with sample, plasma samples and a standard curve were prepared. Briefly, plasma test samples were obtained and stored at ≤60° C. until analyses. Immediately prior to analyses, the test samples were thawed on wet ice and mixed briefly by vortexing just prior to dilution. Then, several serial dilutions of plasma test sample dilutions were prepared in order to ensure at least one sample dilution fell within the range of the calibration curve by dilution in Reagent Diluent (5% Tween-20 PBS solution, prepared by adding 6.5 mL Tween-20 (Sigma; Catalog No. P7949) to 123.5 mL Phosphate Buffered Saline (PBS; Cell-Gro; Catalog No. 21-031-CV)). To assess assay validity, two quality control samples also were diluted for assay. The controls were pooled human plasma collected in $K_3$-EDTA (pooled human $K_3$-EDTA plasma; "low quality control") and pooled human $K_3$-EDTA plasma spiked with exogenous hyaluronan (HA) ("high quality control"). The minimum required dilution (MRD) for human K3-EDTA plasma (used as a control) was 1:4. Dilutions were in polypropylene tubes (e.g., BioRad Titer tubes; BioRad, Catalog No. 223-9391) and were made to a total volume (sample and diluent) of 500 µl. Each dilution was mixed as it was prepared by brief pulse-vortexing. Pipets were changed in between each dilution.

For the standard curve, a hyaluronan stock (132 kD), 1800 ng/mL; R& D Systems, Catalog No. 842164) was diluted by serial dilution in reagent diluent (5% Tween 20 in PBS) to final concentrations of 500 ng/mL, 167 ng/mL, 55.6 ng/mL, 18.5 ng/mL, 6.2 ng/mL, 2.1 ng/mL, and 0.68 ng/mL. A blank well containing reagent diluent also was included in the standard.

Then, at the end of the block step, each well was washed five (5) times with 1×PBST wash buffer (1×PBS, 0.05% Tween 20) using the ELx405Select CW plate washer. The test samples, controls and standard curve were added to the coated and blocked plate by adding 100 µL of each in triplicate to wells of the plate. The plate was covered with an adhesive plate sealer and incubated at ambient temperature for approximately 2 hours. After incubation, each well was washed five (5) times with 1×PBST wash buffer (1×PBS, 0.05% Tween 20) using the ELx405Select CW plate washer.

To detect binding of HA to the coated rHu-aggrecan, a biotinylated rHuAggrecan detection reagent (72 µg/mL; R& D Systems, Catalog No. 842163) was added to the plate. First, 10 mL of a 0.3 µg/mL biotinylated-aggrecan solution was made by diluting the stock solution 240-fold in reagent diluent (5% Tween/PBS). Then, 100 µL of the detection reagent was added to each well. The plate was covered with an adhesive seal and incubated at ambient temperature for approximately 2 hours. Each well was washed five (5) times with 1×PBST wash buffer (1×PBS, 0.05% Tween 20) using the ELx405Select CW plate washer. Then, an Streptavidin-HRP (SA-HRP; R&D Systems, Catalog No. 890803) working solution was prepared in reagent diluent by diluting the stock 200-fold. Then, 100 µL of the dilute SA-HRP working solution was added to each well. The plate was covered with an adhesive seal and incubated at ambient temperature for approximately 20 minutes with shaking at 500 rpm. At the end of the SA-HRP incubation period, each well was washed five (5) times with 1×PBST wash buffer (1×PBS, 0.05% Tween 20) using the ELx405Select CW plate washer. Then, 100 µL of a TMB substrate (KPL; Catalog No. 52-00-03), which was equilibrated to ambient temperature protected from light, was added to each well and incubated at ambient temperature for 20 minutes with shaking at 500 rpm. Then, 100 µL of TMB stop solution (KPL; Catalog No. 50-85-06) was added to each well for at least 5 minutes but less than 30 minutes prior to determining the optical density at 450 nm (OD 450 nm) using a microtiter plate spectrophotometer and SoftMax Pro software.

Based on the OD450 nm value, the concentration of intact hyaluronan for each sample was determined by interpolating from the standard curve. The results were multiplied by the sample dilution factor. The data was reported as the average of all values within the limits of quantitation of the calibration curve in ng/mL. The results are set forth in Tables 11 and 12. The results show that the median plasma HA in healthy humans was 0.015 µg/mL while in phase 1 subjects it was 0.06 µg/mL. This represented a statistically significant difference with a p<0.0001.

TABLE 11

Plasma HA from Subjects with Tumors

| Subject | Tumor Type | Age | Sex | Result (ng/mL) |
|---|---|---|---|---|
| Trial 101 | | | | |
| 1 | Histiocytoma | 86 | M | 44.1 |
| 2 | Colorectal | 62 | M | 32.8 |
| 3 | Rectal | 60 | M | 53.2 |
| 4 | Pancreatic | 57 | F | 59.8 |
| 5 | Bladder | 63 | M | 20.3 |
| 6 | Colon | 66 | F | 52.2 |
| 7 | Pancreatic | 63 | M | 19.5 |
| 8 | Carcinoid | 56 | M | 62.6 |
| 9 | Ovarian | 70 | F | 82.3 |
| 10 | Colon | 60 | F | 254.6 |
| 11 | Prostate | 78 | M | 61.2 |
| 12 | Non small cell lung cancer | 61 | F | 348.3 |
| 13 | Prostate | 71 | M | 30.4 |
| 14 | Prostate | 55 | M | 82.4 |
| Trial 102 | | | | |
| 15 | Ovarian | 55 | F | 67.3 |
| 16 | Esophageal | 71 | M | 88.6 |
| 17 | NSCLC | 65 | F | 59.7 |
| 18 | colon w/ liver mets | 72 | F | 55.4 |
| 19 | colorectal | 62 | F | 207.8 |

TABLE 12

Plasma HA from Healthy Subjects

| Subject | Age | Sex | Result (ng/mL) |
|---|---|---|---|
| 1 | 45 | M | 15.1 |
| 2 | 44 | M | 25.4 |
| 3 | 43 | M | 11.2 |
| 4 | 31 | M | 18.3 |
| 5 | 47 | M | 63.2 |
| 6 | 26 | F | 17 |
| 7 | 28 | F | 13.4 |
| 8 | 21 | F | 13.4 |
| 9 | 41 | F | 12.8 |
| 10 | 24 | F | 12.6 |
| 11 | 19 | F | 7.6 |
| 12 | 33 | F | 18.4 |
| 13 | 28 | F | 18.5 |
| 14 | 21 | F | 14.5 |
| 15 | 35 | F | 19 |
| 16 | 54 | M | 11.7 |
| 17 | 37 | M | 21.9 |
| 18 | 38 | M | 8.3 |
| 19 | 58 | M | 37.5 |
| 20 | 49 | M | 8.6 |

Example 14

Histochemical Detection of HA

Histochemical detection of HA were obtained from a pre-biopsy tumor specimen and a post-treatment metastatic liver biopsy sample from a patient dosed for 4 weeks with 1.6 µg/kg PEGPH20+dexamethasone. The pre-dose biopsy (pre biopsy) was an archived sample obtained in 2007 (3.5 years prior to the treatment with PEGPH20). The post-treatment biopsy sample was obtained 3 days after the last dose ($8^{th}$ dose) in a PEGPH20 plus dexamethasone treatment regimen from a female colon cancer patient with liver metastases. Specifically, the patient post-treatment biopsy was obtained after one cycle of PEGPH20 treatment at 1.6 µg/kg on a twice weekly schedule for the cycle of administration with dexamethasone co-treatment. The treatment cycle was defined as a 28-day period, with PEGPH20 administered intravenously (IV) and dexamethasone administered orally. On each dosing day, a premedication regimen of 4 mg of dexamethasone was administered orally one hour prior to the PEGPH20, followed by a second dose of 4 mg dexamethasone 8-12 hours after PEGPH20 dosing.

Briefly, the tumor biopsies were fixed in normal buffered formalin (NBF) and 5 µm sections cut and stained using a biotin labeled hyaluronan binding protein (HABP-bio) (Seikagaku, Japan). After washing to remove the primary reagent, a labeled secondary reagent was used. Nuclei were counter-stained using a DAPI (4',6-diamidino-2-phenylindole) reagent. Micrographs were captured via a Nikon Eclipse TE2000U inverted fluorescent microscope coupled to a Insight FireWire digital camera (Diagnostic Instruments, Michigan) or ZEISS overhead scope (Carl Zeiss, Inc.) that has the same imaging system.

The histochemical staining of the samples with biotinylated-HA binding protein demonstrated a decrease in pericellular and stromal HA levels after one cycle of PEGPH20 treatment. The results are summarized in Table 13. The H score represents the relative intensity of pericellular and stromal HA. The data demonstrates the ability of PEGPH20 to degrade tumor-associated HA as demonstrated by a reduction of HA staining in the tumor biopsy after treatment.

TABLE 13

Histochemical Detection of HA

| | Pericellular tumor cells (% cells stained) | | | | | Stroma (% area stained) | | | | | % total area | |
|---|---|---|---|---|---|---|---|---|---|---|---|---|
| Specimen | 3+ | 2+ | 1+ | 0 | H | 3+ | 2+ | 1+ | 0 | H | Tumor | Stroma** |
| prebiopsy | 10 | 30 | 25 | 35 | 115 | 30 | 50 | 15 | 5 | 205 | 40 | 50 |
| postbiopsy | 0 | 0 | 25 | 75 | 25 | 30 | 30 | 23 | 17 | 173 | 20 | 5 |

**tumor associated stroma

Example 15

HPLC Method for the Estimation of Hyaluronan (HA) Level in Plasma

This Example describes a method for the determination of the HA-disaccharide content in plasma as a measure of HA catabolites, which are the breakdown products after enzymatic activity of PEGPH20. The method employs the hydrolysis of HA with Chondroitinase ABC to release the HA-disaccharides, derivatize them with 2-amino acridone (AMAC) and analyze them on a reverse-phase HPLC coupled with fluorescence detection. Quantitation of the HA-disaccharides is accomplished by comparison with HA-disaccharide standards. This assay was used to measure the enzymatic activity of PEGPH20 by monitoring concentrations of hyaluronan catabolites in plasma of patients that were selected at schedules times from patients after treatment with PEGPH20.

1. Working Standards.

In the method, a working standard solution was generated. First, a dilute stock solution (DSS) was generated from an HA-disaccharide Stock Solution (SS). The HA disaccharide SS was generated by adding 1 mL of water to a vial of HA-Disac (V-labs, Cat. No. C3209) containing 2 mg of lyophilized powder to make a uniform suspension. To generate dilute stock solutions, 5 µl of the SS solution was diluted with 125 µl of water to generate a DSS1 solution (containing 200 pmoles/µl HA-Disac; 200 nmoles/ml HA-Disac). Five-fold serial dilutions in water were made to generate DSS2 (containing 40 pmoles/µl HA-Disac; 40 nmoles/ml HA-Disac) and then DSS3 (containing 8 pmoles/µl HA-Disac; 8 nmoles/ml HA-Disac). Next, working standard solutions were generated as set forth in 25% human serum albumin (HSA) (ABO Pharmaceuticals, Cat. No. 1500233) or Normal Mouse plasma (Bioreclamation, Cat. No. MSEPLEDTA2-BALB-M) as set forth in Tables 14 and 15.

TABLE 14

Working Standard Solution in HSA

| WSS# | DSS3 | DSS2 | DSS1 | Water (µl) | 25% HSA (µl) | HA0Disac (pmoles in 150 µl) |
|---|---|---|---|---|---|---|
| WSS0 | 0.00 | | | 130.00 | 20.00 | 0 |
| WSS1 | 1.25 | | | 128.70 | 20.00 | 10 |
| WSS2 | 3.13 | | | 126.87 | 20.00 | 25 |
| WSS3 | 6.25 | | | 123.75 | 20.00 | 50 |
| WSS4 | 12.50 | | | 117.50 | 20.00 | 100 |
| WSS5 | | 6.25 | | 123.75 | 20.00 | 250 |
| WSS6 | | 12.50 | | 117.50 | 20.00 | 500 |
| WSS7 | | | 6.25 | 123.75 | 20.00 | 1250 |
| WSS8 | | | 12.50 | 117.50 | 20.00 | 2500 |
| WSS9 | | | 25.00 | 105.00 | 20.00 | 5000 |
| WSS10 | | | 50.00 | 80.00 | 20.00 | 10000 |

TABLE 15

Working Standard Solution in Normal Mouse Plasma

| WSS# | DSS3 | DSS2 | DSS1 | Water (µl) | Normal Mouse Plasma (µl) | HA0Disac (pmoles in 150 µl) |
|---|---|---|---|---|---|---|
| WSS0 | 0.00 | | | 50.00 | 100.00 | 0 |
| WSS1 | 1.25 | | | 48.70 | 100.00 | 10 |
| WSS2 | 3.13 | | | 46.87 | 100.00 | 25 |
| WSS3 | 6.25 | | | 43.75 | 100.00 | 50 |
| WSS4 | 12.50 | | | 37.50 | 100.00 | 100 |
| WSS5 | | 6.25 | | 43.75 | 100.00 | 250 |
| WSS6 | | 12.50 | | 37.50 | 100.00 | 500 |
| WSS7 | | | 6.25 | 43.75 | 100.00 | 1250 |
| WSS8 | | | 12.50 | 37.50 | 100.00 | 2500 |
| WSS9 | | | 25.00 | 25.00 | 100.00 | 5000 |
| WSS10 | | | 50.00 | 00.00 | 100.00 | 10000 |

2. Hydrolysis and Derivation of Samples

Next, the sample was hydrolyzed. The sample (e.g. plasma) was prepared by taking approximately 100 µg of protein in a polypropylene tube and adjusting the volume to 340 µl with water. A matrix blank also was prepared by taking dilution buffer (1.59 g HEPES, 5.07 g NaCl, 1800 mL water, pH 7.0) equal to the volume of the sample and adjusting the volume to 340 µl. Hydrolysis of the samples and matrix blank were effected by adding 60 µl of TFA to the sample tube and matrix blank tube and the contents were mixed and incubated at 100° C. for 4 hours. The vials were allowed to cool to room temperature. The vials were evaporated to dryness using a speed vac. Then, 300 µl of water was added to each tube and vortexed to resuspend the samples.

For derivation of hydrolyzed samples, blanks and working samples, 45 µl of each sample (sample, blank or working sample) was evaporated to dryness in a speed vac. Then, 10 µl of SAS was added to the dried sample, blank and working standards. Then, 50 µl ABA/NaCNBH3 labeling solution was added. The tubes were vortexed and centrifuged briefly. Then, 440 µl of Mobile Phase A was added and the tubes were mixed well. Mobile Phase A was prepared as follows: 132 mL of 1 M ammonium acetate buffer (Sigma, Cat. No. A7330) was added to a 1 L volumetric flask and water added to fill the flask. Following derivation, nominal on-column loads per 20 µl of injection for the working standards is as set forth in Table 16.

TABLE 16

| WSS # | Fuc (pmol) | GalN (pmol) | GlcN (pmol) | Gal (pmol) | Man (pmol) |
|---|---|---|---|---|---|
| WSS1 | 25 | 3.0 | 105 | 42 | 175 |
| WSS2 | 30 | 3.7 | 127 | 51 | 211 |
| WSS3 | 35 | 4.3 | 150 | 60 | 250 |
| WSS4 | 41 | 5.0 | 173 | 69 | 287 |
| WSS5 | 46 | 5.6 | 195 | 78 | 325 |

3. HPLC

The HPLC column was equilibrated at a flow rate of 1.0 mL/min with the initial mobile phase settings as outlined in Table 17. The system was allowed to equilibrate until the baseline was steady. HPLC analysis was performed with the instrument parameters as outlined in Table 17.

TABLE 17

HPLC Instrument Parameters

| Parameter | Values | | |
|---|---|---|---|
| Column | Bakerbond C18 reversed phase column, 4.6 × 250 mm, 5 um | | |
| Column Temperature | Room Temperature | | |
| Mobile Phase A | 0.2% n-butylamine, 0.5% phosphoric acid, 1% tetrahydrofuran in water | | |
| Mobile Phase B | 50% mobile phase A, 50% acetonitrile | | |
| Flow Rate | 1.0 mL/min | | |
| Injection volume | 20 µl | | |
| Detector | Fluorescence; Excitation 360 nm, Emission 425 nm | | |
| Sample condition | 4-6° C. | | |
| | Time (min) | % A | % B |
| Gradient | 0.0 | 95 | 5 |
| | 25.0 | 95 | 5 |
| | 50.0 | 85 | 15 |
| | 50.1 | 0 | 100 |
| | 60.0 | 0 | 100 |
| | 60.1 | 95 | 5 |
| | 70.0 | 95 | 5 |

The sequence for sample analysis was as follows: WSS5 (1 injection) for column conditioning/equilibration/detector gain; water injection (1 injection); WSS3 (3 injections); WSS1 (1 injection); WSS2 (1 injection); WSS4 (1 injection); WSS5 (1 injection); Water (1 injection); Matrix Blank (1 injection); Sample 1 (1 injection); Sample 2 (1 injection); WSS3 (3 injections); Water (1 injection). The system was considered suitable when there was acceptable separation quality; the signal to noise ratio for the shorter monosaccharide peak in the WSS1 sample was equal to or more than 10; the relative standard deviation (RSD) of the peak areas for each monosaccharide standard for the 6 injections of WSS3 was equal or less than 4%; the correlation coefficient (r) was 0.99 (r was measured using software to plot the peak area of each working standard against the on-column load (expressed as pmol) using the first three injections of the WSS3 standard and calculating the slope, intercept and correlation coefficient for the working standards using a linear least square regression model); the peak areas for peaks corresponding to monosaccharides were no more than 2% of the peak area measured for WSS5; and the peak areas for peaks corresponding to monosaccharides in water injection were no more than 0.5% of the peak areas measured for WSS5.

4. Sample Analysis

The average corrected peak area for each monosaccharide in each sample preparation was determined. Valley-to-valley integration was used for the GalN peak. To determine this, the linear curves generated from the working standards were used to calculate the amount of each monosaccharide loaded for each sample preparation. For each type of monosaccharide, the average molar ratio of monosaccharides per protein molecule for each sample was calculated. Then, for each sample, the overall sum of the average molar ratios for all five monosaccharides was determined. The calculations were performed based on the following: Molecular weight (MW) of non-glycosylated hyaluronidase protein is 51106 g/mol; the total volume of each sample was 500 µl; the sample dilution factor is 0.15; the volume of each injection is 20 µl; and the conversion factor from mg to pg is $10^9$. The calculations were performed as follows for each monosaccharide:

The amount of monosaccharide for each preparation was calculated using the following equation:

$$\text{Monosaccharide (pmol)} = \frac{\text{Peak Area} - \text{Intercept}}{\text{Slope}}$$

The number of monosaccharides per protein molecule was calculated by using the following formula:

$$\text{Monosaccharides per protein ratio} = \frac{\text{Monosaccharide (pmol)} \times \text{MW} \times 500 \text{ µl}}{0.1 \text{ mg} \times 10^9 \times 20 \text{ µl} \times 0.15}$$

For each sample, the results for each sample were reported as the monosaccharides per protein ratio for each monosaccharide along with the sum of the five monosaccharide ratios.

5. Results

The disaccharide assay described above was used to measure HA and its catabolites from patients enrolled in phase I clinical studies that received IV doses of PEGPH20 at doses that ranged from 0.5 µg/kg to 50 µg/kg over a dosage regime cycle with or without dexamethasone. Plasma HA concentrations prior to PEGPH20 dosing were typically less than 1 µg/mL or below the level of quantification (0.5 µg/mL) for all patients in the study.

Plasma collected from a a patient that received a single 50 µg/kg dose of PEGPH20 was assessed over time after treatment. The results show that plasma concentrations of hyaluronan increased significantly. In this patient, while PEGPH20 concentrations declined with a terminal half-life of 2 days, elevated concentrations of HA catabolites accumulated more slowly and persist for up to 2 weeks post-PEGPH20 treatment with a maximum HA plasma concentration observed about 200 hours post-PEGPH20 dose.

Plasma also was collected from 12 additional patients beginning 24-hours post initial PEGPH20 dose that were either treated with 0.5 µg/kg PEGPH20 twice weekly (1 patient), 0.5 µg/kg every 21 days (3 patients), 0.75 µg/kg every 21 days (4 patients), 1.0 µg/kg every 21 days (3 patients), or 1.5 µg/kg every 21 days (1 patients). The results show that following single or multiple doses of PEGPH20 that ranged from 0.5 µg/kg to 1.5 gig/kg, HA catabolite levels increased in a dose-dependent manner over the course of a week. Maximal HA concentrations ($C_{max}$) and one-week area-under-the-curve-estimates ($AUC_{0-168h}$) were also determined for each patient to quantify the pharmacodynamic response. The results showed that systemic exposure to HA catabolites, as measured by maximum plasma concentration or area-under-the-curve increased with increasing dose of PEGPH20. In addition, blood samples from patients administered with PEGPH20 where dexamethasone was added to a dosing regime as a premedication to eliminate or ameliorate the musculoskeletal effects caused by PEGPH20 administration. The treatment cycle was defined as a 28-day period, with PEGPH20 administered intravenously (IV) and dexamethasone administered orally. Dosing of PEGPH20 and dexamethasone took place on days 1, 11, 15, 18, 22 and 25 of the 28-day cycle. On each dosing day, a premedication regimen of 4 mg of dexamethasone was administered orally one hour prior to the PEGPH20, followed by a second dose of 4 mg dexamethasone 8-12 hours after PEGPH20 dosing. Plasma was taken at various time points after administration of PEGPH20 during the first week of treatment. Consistent with the observations in the samples from patients receiving only PH20 described above, plasma HA concentration vs. time data increased after administration of PEGPH20. Concentrations of plasma HA measured during the first week of dosing increased with increasing dose of PEGPH20. In three patients that completed a full cycle of treatment and received 8 doses of PEGPH20, the results showed a sustained increased plasma HA concentrations in samples from all three patients measured throughout the dosing period.

These results are consistent with the expected mechanism of PEGPH20 activity and support the role of HA as a biomarker for PEGPH20 pharmacodynamics.

Example 16

Magnetic Resonance Imaging

Diffusion weighted MRI was performed using a single shot spin-echo sequence to estimate pixel-by-pixel values for apparent diffusion coefficient. Dynamic contrast enhanced magnetic resonance imaging (DCE-MRI) included imaging during infusion with a contrast agent. Calibration was accomplished using a two part phantom containing an inner tube and ice/water mixture. Scans were performed pre-treatment and post-treatment.

1. Apparent Diffusion Coefficient Magnetic Resonance Imaging (ADC-MRI)

Apparent diffusion coefficient magnetic Resonance imaging (ADC-MRI) measures the volume of water that has moved across the cell membrane based upon a calculation derived from the pre- and post-treatment scans. ADC-MRI scans were completed for a total of 10 of the 14 patients in a phase I clinical study assessing PEGPH20 treatment without dexamethasone premedication and in 4 of the 5 patients in a phase I clinical study assessing PEGPH20 treatment with dexamethasone premedication. Analysis of the images acquired from each patient was performed by a radiologist at Imaging Endpoints (Scottsdale, Ariz.), and quantitative estimates of ADC were computed for tissues in each patient. A summary of the ADC-MRI findings associated with tumor regions is shown in Table 18. As shown in the Table, increases in ADC-MRI were observed in 7 of 14 (50%) of patients following PEGPH20 dosing. Increased ADC values are consistent with the mechanism of action of PEGPH20. ADC values, however, did not change in 5 of 14 patients, and values decreased in 2 of 14 patients.

TABLE 18

ADC-MRI Summary

| Dose & Frequency | Post-Dose Scan Days | Change in Tumor ADC-MRI from baseline |
|---|---|---|
| Example 15 | | |
| 50 µg/kg | D4 | no change |
| 0.5 µg/kg; 2x/wk | D3 | no change |
| 0.5 µg/kg; 21 day cycle | D3 | increase |
| 0.5 µg/kg; 21 day cycle | D4 | decrease in lymph nodes |
| 0.5 µg/kg; 21 day cycle | D3 | increase |
| 0.75 µg/kg; 21 day cycle | D3 | increase |
| 0.75 µg/kg; 21 day cycle | D3 | no change |
| 0.75 µg/kg; 21 day cycle | D3, D30 | increase |
| 1.0 µg/kg; 21 day cycle | D5 | increase |
| 1.5 µg/kg; 21 day cycle | D3 | no change |
| Example 14 | | |
| 1.6 µg/kg + dexamethasone; 2x/wk | D3, D29 | increase |
| 5.0 µg/kg + dexamethasone; 2x/wk | D1, D4 | increase D1 |
| 1.6 µg/kg + dexamethasone; 2x/wk | D2, D25 | decrease D25 |
| 1.6 µg/kg + dexamethasone; 2x/wk | D1, D2 | no change |

2. Dynamic Contrast Enhanced Magnetic Resonance Imaging (DCE-MRI)

Dynamic contrast enhanced magnetic resonance imaging (DCE-MRI) measures blood flow that indicates a change in tumor's vascularity. Scans were completed in 4 patients in a phase I clinical study assessing PEGPH20 treatment with dexamethasone premedication. Analysis of images acquired from each patient was performed by a radiologist at Imaging Endpoints (Scottsdale, Ariz.), and quantitative estimates of volume transfer coefficient (Ktrans), blood volume (Vp) and extracellular volume fraction (Ve) were computed for tissues in each patient. A summary of the DCE-MRI findings associated with tumor regions is set forth in Table 19. Significant increases in the Ktrans parameter were observed in the two patients that were scanned on the day of PEGPH20 dosing. The increase in Ktrans within hours of dosing is consistent with preclinical data that show PEGPH20 causes vascular decompression and increased blood flow (Thompson et al. (2010) *Mol. Cancer Ther.*, 9:3052-64).

TABLE 19

DCE-MRI Summary

| Dose & Frequency | Post-Dose Scan Days | Change in Tumor DCE-MRI from baseline |
|---|---|---|
| 1.6 µg/kg + dexamethasone; 2x/wk | D3, D29 | decrease in ktrans at D29 |
| 5.0 µg/kg + dexamethasone; 2x/wk | D1, D4 | increase in ktrans, Ve, Vp (8 hr). Return to baseline (D4) |
| 1.6 µg/kg + dexamethasone; 2x/wk | D2, D25 | No baseline scan available. Increase in Vp on D25 vs. D2. No change in Ktrans |
| 1.6 µg/kg + dexamethasone; 2x/wk | D1, D2 | Increase in Ktrans (8 hr, 24 hr. Increase in Ve for lung tumor but not liver tumor (D1, D2). No change in Vp |

DCE-MRI imaging also was performed on a further patient with a pancreatic tumor enrolled in a phase I clinical study receiving 3.0 µg/kg+dexamethasone/wk in a cycle of administration for 28 days. Imaging was performed pre-dose and post-dose as follows: 8 hours (Day 1), 24 hours (Day 2) and 3 days post the $4^{th}$ weekly PEGPH20 dose in cycle 1 (end of cycle 1). The results are set forth in Table 20. The results shows that PEGPH20 increases tumor Ktrans measured by serial DCE-MRI.

TABLE 20

DCE-MRI Results from Patient Dosed 3.0 µg/kg + dexamethasone/wk

| | Baseline | Day 1 | Day 2 | End of Cycle 1 |
|---|---|---|---|---|
| Mean $K^{trans}$ | 0.057 | 0.147 | 0.242 | 0.212 |

3. FDG-PET Imaging

Positron emission tomography (PET) using FDG, an analogue of glucose, was used to give tissue metabolic activity in terms of regional glucose uptake. The FDG-PET imaging was performed on a patient with metastatic rectal carcinoma with lung metastasis enrolled in a phase I clinical study receiving 3.0 µg/kg+dexamethasone; 2x/wk in a cycle of administration for 28 days. Imaging was performed pre-dose, 8 hours post-dose, 24 hours post-dose and at the end of the cycle (1 day after the $8^{th}$ dose). The FDG standardized uptake value (SUV) was determined using standard methods. The results are set forth in Table 21. The results showed that the patient exhibited decreased tumor metabolic activity post-PEGPH20 treatment of landmark pulmonary metastases.

TABLE 21

FDG-PET Results From Patient Dosed 3.0 µg/kg + dexamethasone; 2x/wk

| Anatomical Site | Baseline (SUV) | 8 h (SUV) | Δ baseline to 8 h | 24 h (SUV) | Δ 8 h to 24 h | Day 26 (SUV) | Δ 24 h to Day 26 | Δ baseline to Day 26 |
|---|---|---|---|---|---|---|---|---|
| Superior segment of left lower lobe | 12.9 | 9.4 | −27% | 8 | −15% | 8 | 0% | −38% |
| left lung base | 11.2 | 9.1 | −19% | 7.1 | −22% | 6.7 | −6% | −40% |

TABLE 21-continued

FDG-PET Results From Patient Dosed 3.0 μg/kg + dexamethasone; 2x/wk

| Anatomical Site | Baseline (SUV) | 8 h (SUV) | Δ baseline to 8 h | 24 h (SUV) | Δ 8 h to 24 h | Day 26 (SUV) | Δ 24 h to Day 26 | Δ baseline to Day 26 |
|---|---|---|---|---|---|---|---|---|
| right upper lobe at right perihilar region | 6.8 | 4.5 | −34% | 3.9 | −13% | 4 | +3% | −41% |
| right lower lobe | 8.1 | 5.4 | −33% | 5.2 | −4% | 4.7 | −10% | −42% |

4. Summary

The results show that various tumor imaging modalities can be used to demonstrate and monitor activity of PEGPH20 in tumor tissue.

Example 17

TSG-6-Fc Tumor-Targeted Imaging for HA-Rich Cancer Diagnosis and Treatment

Hyaluronan-rich tumor-bearing mice or control mice were administered with TSG-6-LM-Fc/ΔHep labeled with DyLight 755 Fluor Labeling reagent (TSG-6-LM-Fc/ΔHep$^{DL755}$), and mice were imaged to assess tumor-binding and distribution of TSG-6-LM-Fc/ΔHep$^{DL755}$. Specificity also was assessed by comparing staining and distribution to an IgG$^{DL755}$ control. For generation of BxPC3 peritibial tumor-bearing mice, mice were inoculated with BxPC-3 human pancreatic adenocarcinoma (ATCC CRL-1687) tumor cells subcutaneously (s.c., right hind leg) at 1×10$^7$ cells/0.1 mL. For generation of HA$^{+3}$Du145-Has2 and HA-DU145 tumor-bearing mice, mice were inoculated with both Du145-Has2 cells (generated as described above) and Du145 cells peritibially (intramuscular injection adjacent to the right tibia periosteum on either side) at 5×10$^6$/0.05 mL TSG-6-LM-Fc/ΔHep$^{DL755}$ was generated by fluorescently labeling TSG-6-LM-Fc/ΔHep (generated as described in Example 9) with DyLight 755 using the Thermo Scientific DyLight 755 Amine-Reactive Dye kit (Catalog No. 84538; Thermo Scientific, Rockford, Ill.) according to the manufacturers protocol.

A. Distribution of TSG-6-LM-Fc/ΔHep$^{DL755}$ with and without Pretreatment with PEGPH20

Mice bearing an HA$^{+2}$BxPC3 peritibial tumor at about 18-20 mm in diameter were injected intravenously with 5 μg or 10 μg TSG-6-LM-Fc/ΔHep$^{DL755}$. In one group of mice, mice were pretreated with intravenous administration of PEGPH20 at 4.5 mg/kg three (3) hours prior to administration of TSG-6-LM-Fc/ΔHep$^{DL755}$.

A fluorescent whole body image system (IVIS Lumina XR, Caliper Life Sciences, Mountain View, Calif.) was used to track fluorescence in the animal. Selective excitation of DyLight755 was done using a D745 nm band-pass filter, and the emitted fluorescence was collected through a long-pass D800 nm filter. The 3 groups of mice (non-injected, TSG-6-LM-Fc/ΔHep$^{DL755}$, and PEGPH20+TSG-6-LM-Fc/ΔHep$^{DL755}$) were imaged at various timepoints post TSG-6-LM-Fc/ΔHep$^{DL755}$ (1 hours, 4 hours, day 1, day 2, day 3, day 4, day 5 and day 6). For imaging, non-injected control mice also were assessed. Fluorescent images were captured with a super cooled, high sensitivity, digital camera. Fluorescent images were later analyzed with Living Image (Caliper Life Sciences, Mountain View, Calif.).

The results show that by 1 hour and 4 hours after injection, TSG-6-LM-Fc/ΔHep$^{DL755}$ was detected as circulating in the blood stream, and also was detected as starting to bind to the tumor. The binding to the tumor was dose-dependent, with increased staining intensity observed with the 10 μg dose. Less tumor binding was detected by imaging in mice treated with PEGPH20 at all doses and time points. At later time points after injection (e.g. day 1 or day 2), liver binding also was detected, although this was less in the mice injected with the 1 μg low dose of TSG-6-LM-Fc/ΔHep$^{DL755}$. TSG-6-LM-Fc/ΔHep$^{DL755}$ reached peak levels between day 1 and 2 as assessed by image analysis. In low-dose treated mice, TSG-6-LM-Fc/ΔHep$^{DL755}$ was eliminated day 3 after injection. TSG-6-LM-Fc/ΔHep$^{DL755}$ was sill circulating in high-dose treated mice 5 days post injection, and all binding to the tumor was diminished 6 days after injection.

In sum, the in vivo imaging results show that TSG-6-LM-Fc/ΔHep$^{DL755}$ binding was dose-dependent and reached peaked levels 1-2 days post-injection. Further, HA removal by PEGPH20 resulted in less TSG-6-LM-Fc/ΔHep$^{DL755}$ binding. TSG-6-LM-Fc/ΔHep$^{DL755}$ binding was eliminated from the tumor 6 days post injection.

B. Comparison of TSG-6-LM-Fc/ΔHep$^{DL755}$ Binding Between Du145 Tumor+/−Has2

HA$^{+3}$Du145-Has2 and HA-DU145 tumor-bearing mice were injected intravenously with 5 μg TSG-6-LM-Fc/ΔHep$^{DL755}$. The mice were imaged daily post TSG-6-LM-Fc/ΔHep$^{DL755}$ injection. Although a low-level background staining of HA-DU145 tumor was detected, there was much more TSG-6-LM-Fc/ΔHep DL$^{755}$ binding to HA-rich Du145-Has2 as assessed by image results. The binding peaked at day 1-2 as determined by staining intensity. Thus, the results show that the more HA that is present in the tumor, the more TSG-6-LM-Fc/ΔHep$^{DL755}$ binds to the tumor.

C. Targeting Specificity of TSG-6-LM-Fc/ΔHep$^{DL755}$

The specificity of TSG-6-LM-Fc/ΔHep$^{DL755}$ for HA-rich tumors was further assessed by comparing binding of TSG-6-LM-Fc/ΔHep$^{DL755}$ or IgG$^{DL755}$ to HA$^{+2}$BxPC3 peritibial tumor-bearing mice. HA++BxPC3 peritibial tumor-bearing mice were injected intravenously with 5 μg TSG-6-LM-Fc/ΔHep$^{DL755}$ or with 5 μg IgG$^{DL755}$. The mice were imaged daily after injection. The imaging results showed little to no detectable staining of IgG$^{DL755}$ to the tumor, and thus greater binding of TSG-6-LM-Fc/ΔHep$^{DL755}$ to PC3 tumor than IgG$^{DL755}$.

Since modifications will be apparent to those of skill in this art, it is intended that this invention be limited only by the scope of the appended claims.

SEQUENCE LISTING (426 sequences)

SEQ ID NO: 1 - protein, 509 aa, Homo sapiens
  precursor human PH20
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 2 - protein, 474 aa, Homo sapiens
  mature human PH20, amino acid residues 36-509
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 3 - protein, 482 aa, Homo sapiens
  precursor soluble human PH20, amino acid residues 1-482
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFY

SEQ ID NO: 4 - protein, 447 aa, Homo sapiens [sequence omitted]

SEQ ID NO: 5 - protein, 446 aa, Homo sapiens
  mature soluble human PH20, amino acid residues 36-481
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIF

SEQ ID NO: 6 - protein, 445 aa, Homo sapiens
  mature soluble human PH20, amino acid residues 36-480
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQI

SEQ ID NO: 7 - protein, 444 aa, Homo sapiens
  mature soluble human PH20, amino acid residues 36-479
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQ

SEQ ID NO: 8 - protein, 443 aa, Homo sapiens
  mature soluble human PH20, amino acid residues 36-478
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEP

SEQ ID NO: 9 - protein, 442 aa, Homo sapiens
  mature soluble human PH20, amino acid residues 36-477
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEE

SEQ ID NO: 10 - protein, 450 aa, Bos taurus
  cow hyaluronidase-1 precursor
MRPFSLEVSLHLPWAMAAHLLPVCTLFLNLLSMTQGSRDPVVPNQPFTTIWNANTEWCMKKHGVDVDISIFDVVTNPGQTFRGPNMTIFYSSQLGTYPYYTSAGEPVFGGLPQNASLNAHLARTFQDILAAMPEPRFSGLAVIDWEAWRPRWAFNWDTKDIYRQRSRALVQKQHPDWLAPRVEAAAQDQFEGAAEEWMAGTLKLGQALRPQGLWGFYNFPECYNYDFKSPNYTGRCPLNICAQNDQLGWLWGQSRALYPSIYLPAALEGTKKTQMFVQHRVAEAFRVAAGAGDPKLPVLPYMQLFYDMTNHFLPAEELEHSLGESAAQGAAGVVLWVSWLSTSTKESCQAIKEYVDTTLGPSILNVTSGARLCSQVLCSGHGRCARRPSYPKARLILNSTSFSIKPTPGGGPLTLQGALSLEDRLRMAVEFECRCYRGWRGTRCEQWGMW

SEQ ID NO: 11 - protein, 553 aa, Bos taurus
  cow PH20 hyaluronidase precursor
MRMLRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHMEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSMQSCMNLGTYLNTTLNPYIINVTLAAKMCSQVLCHNEGVCTRKHWNSSDYLHLNPMNFAIQTGEGGKYTVPGTVTLEDLQKFSDTFYCSCYANIHCKKRVDIKNVHSVNVCMAEDICIDSPVKLQPSDHSSSQEASTTTFSSISPSTTTATVSPCTPEKHSPECLKVRCSEVIPNVTQKACQSVKLKNISYQSPIQNIKNQTTY

SEQ ID NO: 12 - protein, 331 aa, Vespula vulgaris
  yellow jacket wasp hyaluronidase A
SERPKRVFNIYWNVPTFMCHQYDLYFDEVTNFNIKRNSKDDFQGDKIAIFYDPGEFPALLSLKDGKYKKRNGGVPQEGNITIHLQKFIENLDKIYPNRNFSGIGVIDFERWRPIFRQNWGNMKIHKNFSIDLVRNEHPTWNKKMIELEASKRFEKYARFFMEETLKLAKKTRKQADWGYYGYPYCFNMSPNNLVPECDVTAMHENDKMSWLFNNQNVLLPSVYVRQELTPDQRIGLVQGRVKEAVRISNNLKHSPKVLSYWWYVYQDETNTFLTETDVKKTFQEIVINGGDGIIIWGSSSDVNSLSKCKRLQDYLLTVLGPIAINVTEAVN

SEQ ID NO: 13 - protein, 340 aa, Vespula vulgaris
  yellow jacket wasp hyaluronidase B
DRTIWPKKGFSIYWNIPTHFCHNFGVYFKELKQFNIKYNSMNNFRGETISLFYDPGNFPSMVLLKNGTYEIRNEGVPQKGNLTIHLEQFTKELDEIYPKKIAGGIGVIHFHNWRPIFRRNVDNLKINKDISIDLVRKEHPKWDKSMIEKEASNRFETSAKIFMEKTLKLAKEIRKKTEWGYHGYPHCLSGSTDKPSFDCDALSMSENDKMSWLFNNQNVLLPSIYLKNVLKPDEKIHLVQERLKEAIRISKNFKHLPKVLPYWWYTYQDKESIFLTEADVKNTFKEILTNGADGIIIWGVSYELTDRKRCEKLKEYLMKILGPIAFKVTKAVKENTPLNF

SEQ ID NO: 14 - protein, 382 aa, Apis mellifera
  honey bee hyaluronidase precursor
MSRPLVITEGMMIGVLLMLAPINALLLGFVQSTPDNNKTVREFNVYWNVPTFMCHKYGLRFEEVSEKYGILQNWMDKFRGEEIAILYDPGMFPALLKDPNGNVVARNGGVPQLGNLTKHLQVFRDHLINQIPDKSFPGVGVIDFESWRPIFRQNWASLQPYKKLSVEVVRREHPFWDDQRVEQEAKRRFEKYGQLFMEETLKAAKRMRPAANWGYYAYPYCYNLTPNQPSAQCEATTMQENDKMSWLFESEDVLLPSVYLRWNLTSGERVGLVGGRVKEALRIARQMTTSRKKVLPYYWYKYQDRRDTDLSRADLEATLRKITDLGADGFIIWGSSDDINTKAKCLQFREYLNNELGPAVKRIALNNNANDRLTVDVSVDQV

SEQ ID NO: 15 - protein, 331 aa, Dolichovespula maculata
  white-face hornet hyaluronidase
SERPKRVFNIYWNVPTFMCHQYGLYFDEVTNFNIKHNSKDDFQGDKISIFYDPGEFPALLPLKEGNYKIRNGGVPQEGNITIHLQRFIENLDKTYPNRNFNGIGVIDFERWRPIFRQNWGNMMIHKKFSIDLVRNEHPFWDKKMIELEASKRFEKYARLFMEETLKLAKKTRKQADWGYYGYPYCFNMSPNNLVPDCDATAMLENDKMSWLFNNQNVLLPSVYIRHELTPDQRVGLVQGRVKEAVRISNNLKHSPKVLSYWWYVYQDDTNTFLTETDVKKTFQEIAINGGDGIIIWGSSSDVNSLSKCKRLREYLLTVLGPITVNVTETVN

SEQ ID NO: 16 - protein, 367 aa, Polistes annularis
  paper wasp hyaluronidase
YVSLSPDSVFNIITDDISHQILSRSNCERSKRPKRVFSIYWNVPTFMCHQYGMNFDEVTDFNIKHNSKDNFRGETISIYYDPGKFPALMPLKNGNYEERNGGVPQRGNITIHLQQFNEDLDKMTPDKNFGGIGVIDFERWKPIFRQNWGNTEIHKKYSIELVRKEHPKWSESMIEAEATKKFEKYARYFMEETLKLAKKTRKRAKWGYYGFPYCYNVTPNNPGPDCDAKATIENDRLSWMYNNQEILFPSVYVRHEQKPEERVYLVQGRIKEAVRISNNLEHSPSVLAYWWYVYQDKMDIYLSETDVEKTFQEIVTNGGDGIIIWGSSSDVNSLSKCKRLREYLLNTLGPFAVNVTETVNGRSSLNF

SEQ ID NO: 17 - protein, 462 aa, Mus musculus
  mouse hyaluronidase-1
MLGLTQHAQKVWRMKPFSPEVSPGSSPATAGHLLRISTLFLTLLELAQVCRGSVVSNRPFITVWNGDTHWCLTEYGVDVDVSVFDVVANKEQSFQGSNMTIFYREELGTYPYYTPTGEPVFGGLPQNASLVTHLAHTFQDIKAAMPEPDFSGLAVIDWEAWRPRWAFNWDSKDIYRQRSMELVQAEHPDWPETLVEAAAKNQFQEAAEAWMAGTLQLGQVLRPRGLWGYYGFPDCYNNDFLSLNYTGQCPVFVRDQNDQLGWLWNQSYALYPSIYLPAALMGTGKSQMYVRHRVQEALRVAIVSRDPHVPVMPYVQIFYEMTDYLLPLEELEHSLGESAAQGVAGAVLWLSSDKTSTKESCQAIKAYMDSTLGPFIVNVTSAALLCSEALCSGHGRCVRHPSYPEALLTLNPASFSIELTHDGRPPSLKGTLSLKDRAQMAMKFRCRCYRGWRGKWCDKRGM

SEQ ID NO: 18 - protein, 473 aa, Mus musculus
  mouse hyaluronidase-2 precursor
MRAGLGPIITLALVLEVAWAGELKPTAPPIFTGRPFVVAWNVPTQECAPRHKVPLDLRAFDVKATPNEGFFNQNITTFYYDRLGLYPRFDAAGTSVHGGVPQNGSLCAHLPMLKESVERYIQTQEPGGLAVIDWEEWRPVWVRNWQEKDVYRQSSRQLVASRHPDWPSDRVMKQAQYEFEFAARQFMLNTLRYVKAVRPQHLWGFYLFPDCYNHDYVQNWESYTGRCPDVEVARNDQLAWLWAESTALFPSVYLDETLASSVHSRNFVSFRVREALRVAHTHHANHALPVYVFTRPTYTRGLTGLSQVDLISTIGESAALGSAGVIFWGDSEDASSMETCQYLKNYLTQLLVPYIVNVSWATQYCSWTQCHGHGRCVRRNPSANTFLHLNASSFRLVPGHTPSEPQLRPEGQLSEADLNYLQKHFRCQCYLGWGGEQCQRNYKGAAGNASRAWAGSHLTSLLGLVAVALTWTL

SEQ ID NO: 19 - protein, 412 aa, Mus musculus
  mouse hyaluronidase-3 precursor
MIMHLGLMMVVGLTLCLMHGQALLQVPEHPFSVVWNVPSARCKAHFGVHLPLDALGIVANHGQHFHGQNISIFYKNQFGLYPYFGPRGTAHNGGIPQAVSLDHHLARAAHQILHSLGSSFAGLAVLDWEEWYPLWAGNWGPHRQVYLAASWVWTQQMFPGLDPQEQLHKAHTSFEQAARALMEYTLQLGRTLRPSGLWGFYRYPACGNGWHKMASNYTGHCHAAITTQNTQLRWLWAASSALFPSIYLPPRLPLAYRQAFVRHRLEEAFRVALLEHSHPLPVLAYSRLTHRSSGRFLSLDDLMQTIGVSAALGTAGVVLWGDLSFSSSEEKCWRLHDYLVGTLGPYVINVTKADMACSHQRCHGHGRCARKDPGQMEAFLHLQPDDSLGAWNSFRCHCYSGWAGPTCLEPKP

SEQ ID NO: 20 - protein, 435 aa, Sus scrofa
  pig hyaluronidase-1 precursor
MAAHLLPICTLFLNLLSVAQGSRDPVVLNRPFTTIWNANTQWCLKRHGVDVDVSVFEVVVNPGQTFRGPNMTIFYSSQLGTYPYYTSAGEPVFGGLPQNASLDVHLNRTFKDILAAMPESNFSGLAVIDWEAWRPRWAFNWDAKDIYRQRSRALVQKQHPDWPAPWVEAAAQDQFQEAAQTWMAGTLKLGQTLRPHGLWGFYGFPDCYNYDFQSSNYTGQCPPGVSAQNDQLGWLWGQSRALYPSIYLPSALEGTNKTQLYVQHRVNEAFRVAAAAGDPNLPVLPYAQIFHDMTNRLLSREELEHSLGESAAQGAAGVVLWVSWENTRTKESCQSIKEYVDTTLGPFILNVTSGALLCSQAVCSGHGRCVRRPSHTEALPILNPSSFSIKPTPGGGPLTLQGALSLKDRVQMAEEFQCRCYPGWRGTWCEQQGTR

SEQ ID NO: 21 - protein, 419 aa, Sus scrofa
  pig hyaluronidase-3 precursor
MTMQLGLALVLGVAMCLGCGQPLLRAPERPFCVLWNVPSARCKARFGVHLPLEALGITANHGQRFHGQNITIFYKSQLGLYPYFGPRGTAHNGGIPQAVSLDHHLARAAYQIHRSLRPGFTGLAVLDWEEWCPLWAGNWGRRQAYQAASCAWAQRVYPNLDPQEQLCKARAGFEEAARALMEDTLRLGRMLRPHGLWGFYHYPACGNGWHGTASNYTGHCHAAALARNTQLYWLWAASSALFPSIYLPPGLPPAYHQAFVRYRLEEAFRVALVGHPHPLPVLAYARLTHRNSGRFLSQDELVQTIGVSAALGASGVVLWGDLSFSSSEEECWHLRGYLVGTLGPYVINVTRAAMACSHQRCHGHGRCAWQDPGQLKVFLHLHPGGSPGAWESFSCRCYWGWAGPTCQEPRPELGPEEAT

SEQ ID NO: 22 - protein, 449 aa, Rattus norvegicus
  rat hyaluronidase-1 precursor
MKPFSPEVSPDPCPATAAHLLRTYTLFLTLLELAQGCRGSMVSNRPFITVWNADTHWCLKDHGVDVDVSVFDVVANKEQNFQGPNMTIFYREELGTYPYYTPTGEPVFGGLPQNASLVTHLAHAFQDIKAAMPEPDFSGLAVIDWEAWRPRWAFNWDSKDIYQQRSMELVRAEHPDWPETLVEAEAQGQFQEAAEAWMAGTLQLGQVLRPRGLWGYYGFPDCYNYDFLSPNYTGQCSLSIHDQNDQLGWLWNQSYALYPSIYLPAALMGTGKSQMYVRYRVQEAFRLALVSRDPHVPIMPYVQIFYEKTDYLLPLEELEHSLGESAAQGAAGAVLWISSEKTSTKESCQAIKAYMDSTLGPFILNVTSAALLCSEALCSGRGRCVRHPSYPEALLTLSPASFSIEPTHDGRPLSLKGTLSLKDRAQMAMKFKCRCYRGWSGEWCKKQDM

SEQ ID NO: 23 - protein, 473 aa, Rattus norvegicus
  rat hyaluronidase-2 precursor
MRAGLGPIITLALVLEVAWASELKPTAPPIFTGRPFVVAWNVPTQECAPRHKVPLDLRAFDVEATPNEGFFNQNITTFYYDRLGLYPRFDAAGMSVHGGVPQNGSLCAHLPMLKEAVERYIQTQEPAGLAVIDWEEWRPVWVRNWQEKDVYRQSSRQLVASRHPDWPSDRIVKQAQYEFEFAARQFMLNTLRYVKAVRPQHLWGFYLFPDCYNHDYVQNWDSYTGRCPDVEVAQNDQLAWLWAENTALFPSVYLDKTLASSKHSRNFVSFRVQEALRVAHTHHANHALPVYVFTRPTYTRRLTELNQMDLISTIGESAALGSAGVIFWGDSVYASSMENCQNLKKYLTQTLVPYIVNVSWATQYCSWTQCHGHGRCVRRNPSASTFLHLSPSSFRLVPGRTPSEPQLRPEGELSEDDLSYLQMHFRCHCYLGWGGEQCQWNHKRAAGDASRAWAGAHLASLLGLVAMTLTWTL

SEQ ID NO: 24 - protein, 412 aa, Rattus norvegicus
  rat hyaluronidase-3 precursor
MITQLGLTLVVGLTLCLVHVQALLQVPEFPFSVLWNVPSARCKTRFGVHLPLDALGIIANHGQRFHGQNITIFYKNQFGLYPYFGPRGTAHNGGIPQAVSLDHHLAQAAHQILHNLGSSFAGLAVLDWEEWYPLWAGNWGTHRQVYQAASWAWAQQMFPDLNPQEQLHKAQTGFEQAARALMEHTLRLGQMLRPHGLWGFYRYPVCGNGWHNMASNYTGHCHPAIITRNTQLRWLWAASSALFPSIYLPPRLPPAYHQTFVRHRLEEAFRVALTGHAHPLPVLAYVRLTHRSSGRFLSLDDLMQTIGVSAALGAAGVVLWGDLSVSSSEEECWRLHDYLVGTLGPYVINVTKAATACSHQRCHGHGRCSWKDPGQMEAFLHLQPDDNLGAWKSFRCRCYLGWSGPTCLEPKP

SEQ ID NO: 25 - protein, 545 aa, Oryctolagus cuniculus
  rabbit hyaluronidase PH20 precursor
MGVLKFKHIFFGSAVELSGVFQIVFIFLLIPCCLTANFRAPPVIPNVPFLWAWNAPTEFCLGKSGEPLDMSLFSLFGSPRKNKTGQGITIFYVDRLGYYPYIDPHTGAIVHGRIPQLGPLQQHLTKLRQEILYYMPKDNVGLAVIDWEEWLPTWLRNWKPKDIYRIKSIELVKSQHPQYNHSYATEKAKRDFEKAGKDFMEETLKLGRLLRPNHLWGYYLFPDCYNHHYDKPNLYKGSCFDIEKKRNDDLSWLWKESTALFPSVYLTSRARSATALSKLYVVRNRVHEAIRVSKIPDDKSPLPNFVYTRLVFTDQIFQFLSHHDLVYTIGEIVALGASGIVVWGSQSLARSMKSCLHLDNYMKTILNPYLINVTLAAKMCNQVLCQEQGVCTRKNWNPNDYLHLNPGNFAIQLGSNGTYKVDGKPTLTDLEQFSKNFQCSCYTNLNCKERTDMNNVRTVNVCAVENVCIDTNVGPQAVTYAPKEKKDVAHILSNTTSINSSTTMSLPFPRKHVSGCLLVLCMYSQYLNICYRLVAIGIQHGYYLK

SEQ ID NO: 26 - protein, 476 aa, Ovis aries
  sheep hyaluronidase-2 precursor
MWTGLGPAVTLALVLVVAWATELKPTAPPIFTGRPFVVAWDVPTQDCGPRHKMPLDPKDMKAFDVQASPNEGFVNQNITIFYRDRLGMYPHFNSVGRSVHGGVPQNGSLWVHLEMLKGHVEHYIRTQEPAGLAVIDWEDWRPVWVRNWQDKDVYRRLSRQLVASHHPDWPPERIVKEAQYEFEFAARQFMLETLRFVKAFRPRHLWGFYLFPDCYNHDYVQNWETYTGRCPDVEVSRNDQLSWLWAESTALFPSVYLEETLASSTHGRNFVSFRVQEALRVADVHHANHALPVYVFTRPTYSRGLTGLSEMDLISTIGESAALGAAGVILWGDAGFTTSNETCRRLKDYLTRSLVPYVVNVSWAAQYCSWAQCHGHGRCVRRDPNAHTFLHLSASSFRLVPSHAPDEPRLRPEGELSWADRNHLQTHFRCQCYLGWGGEQCQWDRRRAAGGASGAWAGSHLTGLLAVAVLAFTWTS

SEQ ID NO: 27 - protein, 114 aa, Ovis aries
  sheep sperm membrane protein PH20 (partial sequence)
LYVRNRVREAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCQEQGVCIR

SEQ ID NO: 28 - protein, 414 aa, Pongo pygmaeus
  orangutan hyaluronidase-3 precursor
MTTRLGPALVLGVALCLGCGQPLPQVPERPFSVLWNVPSAHCKSRFGVHLPLNALGIIANRGQHFHGQNMTIFYKNQLGLYPYFGPKGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHLPVLAYVRLTHRRSGRFLSQDDLVQTIGVSAALGAAGVVLWGDLSLSSSEEECWHLHDYLVDTLGPYGINVTRAAMACSHQRCHGHGRCARRDPGQMEAFLHLWPDGSLGDWKSFSCHCYWGWAGPTCQEPRLGPKEAV

SEQ ID NO: 29 - protein, 510 aa, Macaca fascicularis
  cynomolgus monkey hyaluronidase PH20 precursor
MGVLKFKHIFFRSFVKSSGVSQIVFTFLLIPCCLTLNFRAPPIIPNVPFLWAWNAPSEFCLGKFNEPLDMSLFTLMGSPRINVTGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIVNILFLIISSVASL

SEQ ID NO: 30 - protein, 529 aa, Cavia porcellus
  guinea pig hyaluronidase PH20 precursor
MGAFTFKHSFFGSFVECSGVLQTVFIFLLIPCCLADKRAPPLIPNVPLLWVWNAPTEFCIGGTNQPLDMSFFSIVGTPRKNITGQSITLYYVDRLGYYPYIDPHTGAIVHGGLPQLMNLQQHLRKSRQDILFYMPTDSVGLAVIDWEEWRPTWTRNWRPKDIYRNKSIELVKSQHPQYNHSYAVAVAKRDFERTGKAFMLETLKLGKSLRPSSLWGYYLFPDCYNTHFTKPNYDGHCPPIELQRNNDLQWLWNDSTALYPSVYLTSRVRSSQNGALYVRNRVHESIRVSKLMDDKNPLPIYVYIRLVFTDQTTTFLELDDLVHSVGEIVPLGVSGIIIWGSLSLTRSLVSCIGLENYMKGTLLPYLINVTLAAKMCGQVLCKNQGICTRKDWNTNTYLHLNATNFDIELQQNGKFVVHGKPSLEDLQEFSKNFHCSCYTNVACKDRLDVHNVRSVNVCTANNICIDAVLNFPSLDDDDEPPITDDTSQNQDSISDITSSAPPSSHILPKDLSWCLFLLSIFSQHWKYLL

SEQ ID NO: 31 - protein, 512 aa, Rattus norvegicus
  rat hyaluronidase PH20 precursor
MGELQFKWLFWRSFAESGGTFQTVLIFLFIPYSLTVDYRATPVLSDTTFVWVWNVPTEACVENVTEPIDLSFFSLIGSPRKTAIGQPVTLFYVDRLGNYPHIDAQQTEHHGGIPQKGDLTTHLVKAKEDVERYIPTDKLGLAIIDWEEWRPTWMRNWTPKDIYRNKSIELVQAADPAINITEATVRAKAQFEGAAKEFMEGTLKLGKHIRPKHLWGFYLFPDCYNNKFQVDNYDGQCPDVEKKRNDDLDWLWKESTGLYPSVYLKKDLKSSRKATLYVRYRVLESIRVSKVSDESNPVPIFVYIRLVFTDHVSEYLLEDDLVNTIGEIVAQGTSGIIIWDAMSLAQRSAGCPILRQYMKTTLNPYIVNVTLAAKMCSQTLCKEKGMCSRKTESSDAYLHLDPSSFSINVTEAGKYEVLGKPEVKDLEYFSEHFKCSCFSKMTCEETSDMRSIQDVNVCMGDNVCIKATLGPNSAFHLLPGKGLLLMTTLAHILHHLPHDIFVFPWKMLVSTP

SEQ ID NO: 32 - protein, 512 aa, Mus musculus
  mouse hyaluronidase PH20 precursor
MGELRFKHLFWGSFVESGGTFQTVLIFLLIPCSLTVDYRAAPILSNTTFLWIWNVPTERCVGNVNDPIDLSFFSLIGSPRKTATGQPVTLFYVDRLGLYPHIDANQAEHYGGIPQRGDYQAHLRKAKTDIEHYIPDDKLGLAIIDWEEWRPTWLRNWKPKDNYRNKSIELVQSTNPGLSITEATQKAIQQFEEAGRKFMEGTLHLGKFLRPNQLWGYYLFPDCYNNKFQDPKYDGQCPAVEKKRNDNLKWLWKASTGLYPSVYLKKDLKSNRQATLYVRYRVVEAIRVSKVGNASDPVPIFVYIRLVFTDRTSEYLLEDDLVNTIGEIVALGTSGIIIWDAMSLAQRAAGCPILHKYMQTTLNPYIVNVTLAAKMCSQTLCNEKGMCSRRKESSDVYLHLNPSHFDIMLTETGKYEVLGNPRVGDLEYFSEHFKCSCFSRMTCKETSDVKNVQDVNVCVGDNVCIKAKVEPNPAFYLLPGKSLLFMTTLGHVLYHLPQDIFVFPRKTLVSTP

SEQ ID NO: 33 - protein, 807 aa, Staphylococcus aureus
  Staphylococcus aureus subsp. aureus COL hyaluronate lyase
MTYRIKKWQKLSTITLLMAGVITLNGGEFRSVDKHQIAVADTNVQTPDYEKLRNTWLDVNYGYDKYDENNPDMKKKFDATEKEATNLLKEMKTESGRKYLWSGAETLETNSSHMTRTYRNIEKIAEAMRNPKTTLNTDENKKKVKDALEWLHKNAYGKEPDKKVKELSENFTKTTGKNTNLNWWDYEIGTPKSLTNTLILLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYHDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITVKKESHTGKWKEINKSQKDTQKTDEYYEVTQKHSNSDNKYGYVLYPGLSKDVFKTKKDEVTVVKQEDDFHVVKDNESVWAGVNYSNSTQTFDINNTKVEVKAKGMFILKKKDDNTYECSFYNPESTNSASDIESKISMTGYSITNKNTSTSNESGVHFELTK

SEQ ID NO: 34 - protein, 371 aa, Streptococcus pyogenes
  Streptococcus pyogenes bacteriophage H4489A hyaluronidase
MTENIPLRVQFKRMSADEWARSDVILLEGEIGFETDTGFAKFGDGQNTFSKLKYLTGPKGPKGDTGLQGKTGGTGPRGPAGKPGTTDYDQLQNKPDLGAFAQKEETNSKITKLESSKADKSAVYSKAESKIELDKKLSLTGGIVTGQLQFKPNKSGIKPSSSVGGAINIDMSKSEGAAMVMYTNKDTTDGPLMILRSDKDTFDQSAQFVDYSGKTNAVNIVMRQPSAPNFSSALNITSANEGGSAMQIRGVEKALGTLKITHENPNVEAKYDENAAALSIDIVKKQKGGKGTAAQGIYINSTSGTAGKMLRIRNKNEDKFYVGPDGGFHSGANSTVAGNLTVKDPTSGKHAATKDYVDEKIAELKKLILKK

SEQ ID NO: 35 - protein, 1628 aa, Clostridium perfringens
  Clostridium perfringens str. 13 hyaluronidase
MNKNIRKIITSTVLAAMTISVLPSNLVVFATDGITENFYEIYPKPQEISYSGGEFQISDEINIVYDDGIDTYTKKRVDEVLEASNLEATVSNEIVPGKTNFLVGINESGGVVDNYFNKNIPHDESFFDEKMDANIVSVKDGVIGVIGEDTDSAFYGVTTLKHVFNQLEEGNKIQSFRADDYAEVAHRGFIEGYYGNPWSNEDRAELMKFGGDYKLNQYVFAPKDDPYHNSKWRDLYPEEKLSEIKKLAQVGNETKNRYVYALHPFMNNPVRFDTEENYQNDLGVIKAKFTQLLENDVRQFAILADDASAPAQGASMYVKLLTDLTRWLEEQQSTYPDLKTDLMFCPSDYYGNGSSAQLKELNKAEDNVSIVMTGGRIWGEVDENFANNFMNNISTEGHPGRAPFFWINWPCSDNSKQHLIMGGNDTFLHPGVDPSKIDGIVLNPMQQAEANKSALFAIADYAWNIWDNKEEADENWNDSFKYMDHGTAEETNSSLALREISKHMINQNMDGRVRPLQESVELAPKLEAFKQKYDSGASIKEDALELIAEFTNLQKAADYYKNNPGNERTRDQIIYWLNCWEDTMDAAIGYLKSAIAIEEGDDEAAWANYSEAQGAFEKSKTYGFHYVDHTEYAEVGVQHIVPFIKSMGQNLSVVIGSIVDPNRIIATYISNRQDAPTGNPDNIFDNNASTELVYKNPNRIDVGTYVGVKYSNPITLNNVEFLMGANSNPNDTMQKAKIQYTVDGREWIDLEEGVEYTMPGAIKVENLDLKVRGVRLIATEARENTWLGVRDINVNKKEDSNSGVEFNPSLIRSESWQVYEGNEANLLDGDDNTGVWYKTLNGDTSLAGEFIGLDLGKEIKLDGIRFVIGKNGGGSSDKWNKFKLEYSLDNESWTTIKEYDKTGAPAGKDVIEESFETPISAKYIRLTNMENINKWLTFSEFAIISDELENAGNKENVYTNTELDLLSLAKEDVTKLIPTDDISLNHGEYIGVKLNRIKDLSNINLEISNDTGLKLQSSMNGVEWTEITDKNTLEDGRYVRLINTSNEAVNFNLTKFEVNSNEVYEPSLVDAYVGDDGAKKAVDGDLKTRVKFLGAPSTGDTIVYDLGQEILVDNLKYVVLDTEVDHVRDGKIQLSLDGETWTDAITIGDGVENGVDDMFSTPLKNGYKHGNQSGGIVPIDSAYVEGDNLNQKARYVRILFTAPYRHRWTVINELMINNGEYISTVNDPTYISNPIEERGFAPSNLRDGNLTTSYKPNTNNGEISEGSITYRLSEKTDVRKVTIVQSGSSISNAKVMARVGDGSENVTDQWVQLGTLSNSLNEFINRDYNNIYEIKIEWTDVAPNIYEIITLNQEFEFPVNDSLKAKYDELINLSGDEYTLSSFETLKEALNEAKSILDDSNSSQKKIDKALEKLNKAEERLDLRATDFEDFNKVLTLGNSLVEEEYTAESWALFSEVLEAANEANKNKADYTQDQINQIVIDLDASIKALVKETPEVDKTNLGELINQGKSLLDESVEGFNVGEYHKGAKDGLTVEINKAEEVFNKEDATEEEINLAKESLEGAIARFNSLLIEESTGDFNGNGKIDIGDLAMVSKNIGSTTNTSLDLNKDGSIDEYEISFINHRILN

SEQ ID NO: 36 - protein, 435 aa, Homo sapiens
  human hyaluronidase-1 precursor
  SIGNAL (1)...(21): signal sequence
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 37 - protein, 473 aa, Homo sapiens
  human hyaluronidase-2 precursor
  SIGNAL (1)...(20): signal sequence
MRAGPGPTVTLALVLAVAWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRVEHYIRTQESAGLAVIDWEDWRPVWVRNWQDKDVYRRLSRQLVASRHPDWPPDRIVKQAQYEFEFAAQQFMLETLRYVKAVRPRHLWGFYLFPDCYNHDYVQNWESYTGRCPDVEVARNDQLAWLWAESTALFPSVYLDETLASSRHGRNFVSFRVQEALRVARTHHANHALPVYVFTRPTYSRRLTGLSEMDLISTIGESAALGAAGVILWGDAGYTTSTETCQYLKDYLTRLLVPYVVNVSWATQYCSRAQCHGHGRCVRRNPSASTFLHLSTNSFRLVPGHAPGEPQLRPVGELSWADIDHLQTHFRCQCYLGWSGEQCQWDHRQAAGGASEAWAGSHLTSLLALAALAFTWTL

SEQ ID NO: 38 - protein, 417 aa, Homo sapiens
  human hyaluronidase-3 precursor
  SIGNAL (1)...(20): signal sequence
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHRHPLPVLAYVRLTHRRSGRFLSQDDLVQSIGVSAALGAAGVVLWGDLSLSSSEEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 39 - protein, 481 aa, Homo sapiens
  human hyaluronidase-4
MKVLSEGQLKLCVVQPVHLTSWLLIFFILKSISCLKPARLPIYQRKPFIAAWNAPTDQCLIKYNLRLNLKMFPVIGSPLAKARGQNVTIFYVNRLGYYPWYTSQGVPINGGLPQNISLQVHLEKADQDINYYIPAEDFSGLAVIDWEYWRPQWARNWNSKDVYRQKSRKLISDMGKNVSATDIEYLAKVTFEESAKAFMKETIKLGIKSRPKGLWGYYLYPDCHNYNVYAPNYSGSCPEDEVLRNNELSWLWNSSAALYPSIGVWKSLGDSENILRFSKFRVHESMRISTMTSHDYALPVFVYTRLGYRDEPLFFLSKQDLVSTIGESAALGAAGIVIWGDMNLTASKANCTKVKQFVSSDLGSYIANVTRAAEVCSLHLCRNNGRCIRKMWNAPSYLHLNPASYHIEASEDGEFTVKGKASDTDLAVMADTFSCHCYQGYEGADCREIKTADGCSGVSPSPGSLMTLCLLLLASYRSIQL

SEQ ID NO: 40 - protein, 467 aa, Homo sapiens
  precursor soluble human PH20, amino acid residues 1-467
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDA

SEQ ID NO: 41 - protein, 477 aa, Homo sapiens
  precursor soluble human PH20, amino acid residues 1-477
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEE

SEQ ID NO: 42 - protein, 478 aa, Homo sapiens
  precursor soluble human PH20, amino acid residues 1-478
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEP

SEQ ID NO: 43 - protein, 479 aa, Homo sapiens
  precursor soluble human PH20, amino acid residues 1-479
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQ

SEQ ID NO: 44 - protein, 480 aa, Homo sapiens
  precursor soluble human PH20, amino acid residues 1-480
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQI

SEQ ID NO: 45 - protein, 481 aa, Homo sapiens
  precursor soluble human PH20, amino acid residues 1-481
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIF

SEQ ID NO: 46 - protein, 483 aa, Homo sapiens
  precursor soluble human PH20, amino acid residues 1-483
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYN

SEQ ID NO: 47 - protein, 432 aa, Homo sapiens
  mature soluble human PH20, amino acid residues 36-467
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDA

SEQ ID NO: 48 - protein, 448 aa, Homo sapiens
  mature soluble human PH20, amino acid residues 36-483
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYN

SEQ ID NO: 49 - DNA, 1446 bp, Homo sapiens
  DNA encoding soluble human PH20 precursor
atgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctac

SEQ ID NO: 50 - protein, 509 aa, Homo sapiens
  precursor human PH20 variant P48A
  SIGNAL (1)...(35): signal sequence
MGVLKFKHIFFRSFVKSSGVSQIVFTFLLIPCCLTLNFRAPPVIPNVAFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 51 - protein, 509 aa, Homo sapiens
  precursor human PH20 variant L499W
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIWFLIISSVASL

SEQ ID NO: 52 - DNA, 6630 bp, Artificial Sequence
  HZ24 vector
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctactgaggatccatagctaacgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacagcggccgctgccatcatggttcgaccattgaactgcatcgtcgccgtgtcccaaaatatggggattggcaagaacggagacctaccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaaacgcgtggtacctctagagtcgacccgggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataaggatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatggctcgacagatct

SEQ ID NO: 53 - protein, 186 aa, Mus musculus
  mouse dihydrofolate reductase protein
VRPLNCIVAVSQNMGIGKNGDLPWPPLRNEFKYFQRMTTTSSVEGKQNLVIMGRKTWFSIPEKNRPLKDRINIVLSRELKEPPRGAHFLAKSLDDALRLIEQPELASKVDMVWIVGGSSVYQEAMNQPGHLRLFVTRIMQEFESDTFFPEIDLGKYKLLPEYPGVLSEVQEEKGIKYKFEVYEKKD

SEQ ID NO: 54 - protein, 6 aa, Artificial Sequence
  His tag
HHHHHH

SEQ ID NO: 55 - protein, 8 aa, Artificial Sequence
  Flag tag
DYKDDDDK

SEQ ID NO: 56 - DNA, 1449 bp, Homo sapiens
  PH20 mRNA sequence from 3D35M cells (contains c to a at base 1131)
atgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagtcaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctactga

SEQ ID NO: 57 - protein, 17 aa, Homo sapiens
  C-terminal peptide cleaved from soluble human PH20, amino acid residues 431-447
DAFKLPPMETEEPQIFY

SEQ ID NO: 58 - protein, 16 aa, Homo sapiens
  C-terminal peptide cleaved from soluble human PH20, amino acid residues 431-446
DAFKLPPMETEEPQIF

SEQ ID NO: 59 - protein, 15 aa, Homo sapiens
  C-terminal peptide cleaved from soluble human PH20, amino acid residues 431-445
DAFKLPPMETEEPQI

SEQ ID NO: 60 - protein, 14 aa, Homo sapiens
  C-terminal peptide cleaved from soluble human PH20, amino acid residues 431-444
DAFKLPPMETEEPQ

SEQ ID NO: 61 - protein, 13 aa, Homo sapiens
  C-terminal peptide cleaved from soluble human PH20, amino acid residues 431-443
DAFKLPPMETEEP

SEQ ID NO: 62 - protein, 12 aa, Homo sapiens
  C-terminal peptide cleaved from soluble human PH20, amino acid residues 431-442
DAFKLPPMETEE

SEQ ID NO: 63 - protein, 520 aa, Ovis aries
  sheep PH20
LDFPAPPLISNTSFLWAWNAPAERCVKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYNTTLNPYIINVTLAAKMCSQVLCHDEGVCTRKQWNSSDYLHLNPIMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVVSPCTPEKQSPECLKVRCLEAIANVTQTGCQGVKWKNTSSQSQSSIQNIKNQTT

SEQ ID NO: 64 - protein, 474 aa, Bos taurus
  cow hyaluronidase PH20
MGMFRRHHISFRSFAGSSGTPQAVFTFLLLPCCLALDFRAPPLISNTSFLWAWNAPVERCVNRRFQLPPDLRLFSVKGSPQKSATGQFITLFYADRLGYYPHIDEKTGKTVFGGIPQLGNLKSHLEKAKNDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNHNQPTYNGNCPDVEKRRNDDLEWLWKESTALFPSVYLNIRLKSTQNAALYVRNRVQEAIRLSKIASVESPLPVFVYARPVFTDGSSTYLSQGDLVNSVGEIVSLGASGIIMWGSLNLSLSVQSCMNLGTYLNTTLNPYIINVTLAAKMCSQVLCHDGGVCTRKHWNSSDYLHLNPMNFAIQTGEGGKYTVPGTLTLEDLQKFSDTFYCSCYSNLSCKKRVDIKNVHSVDVCMAEDVCIDAFLKPP

SEQ ID NO: 65 - protein, 517 aa, Ovis aries
  sheep PH20
DFRAPPLISNTSFLWAWNAPAERCIKIFKLPPDLRLFSVKGSPQKSATGQFITLFYADRLGYYPHIDEKTGNTVYGGIPQLGNLKNHLEKAKKDIAYYIPNDSVGLAVIDWENWRPTWARNWKPKDVYRDESVELVLQKNPQLSFPEASKIAKVDFETAGKSFMQETLKLGKLLRPNHLWGYYLFPDCYNHNYNQPTYNGNCSDLEKRRNDDLDWLWKESTALFPSVYLNIKLKSTPKAAFYVRNRVQEAIRLSKIASVESPLPVFVYHRPVFTDGSSTYLSQGDLVNSVGEIVALGASGIIMWGSLNLSLTMQSCMNLGNYLNTTLNPYIINVTLAAKMCSQVLCHDEGVCTRKQWNSSDYLHLNPMNFAIQTGKGGKYTVPGKVTLEDLQTFSDKFYCSCYANINCKKRVDIKNVHSVNVCMAEDICIEGPVKLQPSDHSSSQNEASTTTVSSISPSTTATTVSPCTPEKQSPECLKVRCLEAIANVTQTGCQGVKWKNTSSQSSIQNIKNQTTY

SEQ ID NO: 66 - DNA, 1620 bp, Ovis aries
  DNA encoding sheep PH20
ttttccgtgttggttggctctggacttcagagcaccccctctcatttcaaacacttctttcctctgggcctggaatgccccagctgaacgttgtattaaaatctttaaactacctccagatctgagactcttctctgtaaaaggaagcccccaaaaaagtgctacgggacaatttattacattattttatgctgatagacttggctactatcctcatatagatgaaaaaacaggcaacactgtatatggaggaattccccagttgggaaacttaaaaaatcatttggaaaaagccaaaaaagacattgcctattacataccaaatgacagcgtgggcttggcggtcattgactgggaaaactggaggcctacctgggcaagaaactggaaacctaaagatgtttacagggatgagtctgttgagttggttctgcaaaaaaatccacaactcagtttcccagaggcttccaagattgcaaaagtggattttgagacagcaggaaagagtttcatgcaagagactttaaaactgggaaaattacttcggccaaatcacttatggggttattatctttttcctgattgttacaatcataattataaccagcctacttacaatggaaattgctctgatttagaaaaaaggagaaatgatgatctcgactggttgtggaaggaaagcactgcccttttcccttctgtttatttgaatatcaagttaaaatctactccaaaagctgccttctatgttcgtaatcgtgtccaggaagccattcggttgtctaaaatagcgagtgttgaaagtccacttcccgtttttgtatatcaccgtccagtttttactgatgggtcttcaacatacctttctcagggtgaccttgtgaattcggttggtgagatcgttgctctaggtgcctctgggattataatgtggggcagtctcaatctaagcctaactatgcaatcttgcatgaacctaggcaattacttgaacactacactgaatccttacataatcaacgtcaccctagcagccaaaatgtgcagccaagtgctttgccacgatgaaggagtgtgtacaaggaaacaatggaattcaagcgactatcttcacctgaacccaatgaattttgctattcaaactgggaaaggtggaaaatacacagtacctgggaaagtcacacttgaagacctgcaaacgttttctgataaattttattgcagttgttatgccaacatcaactgtaagaagagagttgatataaaaaatgttcatagtgttaatgtatgtatggcagaagacatttgtatagagggccctgtgaagttacaacccagtgatcattcctctagccagaatgaggcatctactaccaccgtcagcagtatctcaccctctactacagccaccacagtatctccatgtactcctgagaaacagtcccctgagtgcctcaaagtcaggtgtttggaagccatcgccaacgtcacccaaacggggtgtcaaggtgttaaatggaagaacacttccagtcagtcaagtattcaaaatattaaaaatcaaacaacctattaaaatataaattcagtgcttataaaaaaaaaaaaaaaaaaaaaaaa

SEQ ID NO: 67 - protein, 793 aa, Arthrobacter sp.
  Arthrobacter sp. FB24 hyaluronate lyase
MTREFSRRTALKGAALSGLLLAMVHGPAHAAATANATLTPADFAGLRQRWVDQITGRKVLVAGDNDFVTALAALDKKARTAIDLLERSAGRLTVFSDLSLAKDTDLVTTHTRLATMATAWATPGSEHFADAGLLAAIRAGLADANSLCYNASKEEQGNWWSWEIGTPKALADTMVLLHAELTAAERAAYCAAIDHFVPDPWQQFPPKRGKITSVGANRVDLCQAVTIRSLVDEDAEKLTHAVAGLSEVWQYVSAGNGFFTDGSFIQHSTTPYTGSYGVVLLTGLSKLFALLGGTGAEVSDPSRDILFKTVEGSFAPFMVAGAMADSVRGRSISRESNTGFDLGASTIESILLLARAVDPVTARRWRSLCLAWINQNRKAPILADAGVGRTALVKELLAMGLTETDLPGGHYLFPAMDRTMHHSQGWTLSTAMASSRIAWYECGNGENNRGYHTGSGMTYVYDGDLGQYDDAFWATANHCRLPGITVDTSSLPDKVEGEWGAATPANEWTGSTAYGDVAAVGQHLIGPGGTGLTARKSWFVSKDVIVCLGADIRTGSGSRIETVVDHRNLHAGFNAMGTAAGTVAATPGHPEVLTVDRWVHLEGFGGYVVLDAAPLQVLREQREGSWSEVNVKGSAARQTRNYATLYFDHGHEPEAASYAYLVAPGASASMTSSLSGQSFHTVLRNDEVAQAVKFKKEKTTAATFWRPGTVGDLALSGPACVVVKEVGDRLSIAVSDPTQNASTLTLRLKTKRFFRIIEGQGASLSHGADGFTVLEVDIANHAGRTKQIELSAE

SEQ ID NO: 68 - protein, 557 aa, Bdellovibrio bacteriovorus
  Bdellovibrio bacteriovorus HD100 hypothetical hyaluronan lyase
MTKFFFLLTLISATAFAQSEPDWTAGVPVPPGGRSNIYSWNDFDFQATLNKGKIHAQVYPVTVTGMLPPYEPVRRLIEEKNSNPLRKWIQSLMKGLSGFRSFEDVLKNLGLHKYPLENERGVYAVPYPNEIRPDTLMGFGLIERNGAEGFTFSCAACHSSNLFGKTVLGMTNRFPRANEFFIKAKKVMPLMDPHIFQAYTRATDAETALLVESKERLKSVALKQPIALGLDTSLAQVSLSLNRRAKDGYANYSDKAARSPRADAYLDNKPADSKPAVWWNVKYKNRWLSDGSVLSGNPIFTNLIWNEIGRGADLHELEQWLADNDHIIKELTTAVFASEAPHITDFYPAEKIDLGRAKAGEQIFKNTCAKCHGHYEKAWNLPQALVLSAAERLKTVEVRYKEKTPVVNVGTDPFRRQGMKSLEQLNDLEISKKNGIVIKAQEGYVPPPLVGIWARWPYMHNNSIPNLCVLLTPAKKRPSIYYSGEALNKDTDYDFSCGGYPIGDKTPKAWKTREHLYDTRNPGMGNMGHDEGIFIKDGKEILSAEDKYNLIQFLQTL

SEQ ID NO: 69 - protein, 813 aa, Propionibacterium acnes
  Propionibacterium acnes KPA171202 hyaluronate lyase
MFGTPSRRTFLTASALSAMALAASPTVTDAIAAPGPDSWSALCERWIDIITGRRAARTSDPRARAIIAKTDRKVAEILTDLVSGSSRQTVLISADLRKEQSPFITKTARAIESMACAWATPGSSYHKDPEILSACIEGLRDFCRLRYNPSQDEYGNWWDWEDGASRAVADVMCILHDVLPPEVMSAAAAGIDHFIPDPWFQQPASVKPTANPVQPVVSTGANRMDLTRAVMCRSIATGDEKRLRHAVDGLPDAWRVTTEGDGFRADGGFIQHSHIPYTGGYGDVLFSGLAMLFPLVSGMRFDIVESARKAFHDQVERGFIPVMYNGQILDDVRGRSISRINESAAMHGISIARAMLMMADALPTHRAEQWRGIVHGWMARNTFDHLSEPSTLVDISLFDAAAKARPVPESSTPSYFASMDRLVHRTADWLITVSNCSDRIAWYEYGNGENEWASRTSQGMRYLLLPGDMGQYEDGYWATVDYSAPTGTTVDSTPLKRAVGASWAAKTPTNEWSGGLASGSWSAAASHITSQDSALKARRLWVGLKDAMVELTTDVTTDASRAITVVEHRKVASSSTKLLVDGNRVSSATSFQNPRWAHLDGVGGYVFATDTDLSADVATRKGTWIDVNPSRKVKGADEVIERAYASLHVTHHDRPVAWALLPTASRSHTMALATRPGVEPFTVLRNDATVQAVRSAGALLTKDPTVVTTLAFWKPATCGGVAVNRPALVQTRESANQMEVVIVEPTQKRGSLTVTIEGSWKVKTADSHVDVSCENAAGTLHVDTAGLGGQSVRVTLARQVTQTPSGGGRHDRA

SEQ ID NO: 70 - protein, 1072 aa, Streptococcus agalactiae
  Streptococcus agalactiae hyaluronate lyase
MEIKKKYRIMLYSALILGTILVNNSYQAKAEELTKTTSTSQIRDTQTNNIEVLQTESTTVKETSTTTTQQDLSNPTASTATATATHSTMKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKMLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 71 - protein, 1072 aa, Streptococcus agalactiae
  Streptococcus agalactiae 18RS21 hyaluronate lyase
MEIKKKHRIMLYSALILGTILVNNSYQAKAEELTKTTSTSQIRDTQTNNIEVLQTESTTVKETSTTTTQQDLSNPTASTATATATHSTMKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLISTIKTIITSNKFYNVFNNLKSYSDIANMNKMLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 72 - protein, 1081 aa, Streptococcus agalactiae
  Streptococcus agalactiae A909 hyaluronate lyase
MEIKKKHRIMLYSALILGTILVNNSYQAKAEEFTKTTSTSQIRDTQTNNVEVPQTESTTVKGTSTTTTQQDLSNSTASTATATATHSTMKQVVDNQTQNKELVKNGDFKEKIIDKKIDKKSQWTNLYGAKDWNTYIDQTKSVNKSPIIQRTEQGQVSLSSDKGFRGAVTQKVNIDPTKKYEVKFDIETSNKVGQAFLRIMKKKDKNTRLWLSEMTSGTTNKHTLTKIYNPKLNVSEVTLELYYEKGTGSVTFDNISMKAKGPKDSEHPQPVTTQIEESVNTALNKNYVFNKADYQYTLTNPSLGKIVGGILYPSATGSTTVKISDKSGKIIKEVPLSVTASTEDNFTKLLDKWNDVTIGNHVYDTNDSNMQKLNQKLDETNAKNIKDIKLDSNRTFLWEDLKGLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLVNPFKALGGNLVDMGRVKIIEGLLRKDNTIIKKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKLLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDTGREDTIKKLMNRYDKTNKNSKVMTGQVTGTSDFVGSVKLNDHFALAAMDFTNWDRTLTAQKGWVILNDKIVFLGSNIKNTNGVGNVSTTIDQRKDDSKTPYTTYVNGKTVDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 73 - protein, 984 aa, Streptococcus agalactiae
  Streptococcus agalactiae NEM316 hyaluronate lyase
MKQVVDNQTQNKELVKNGDFNQTNPVSGSWSHTSAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLNVSEVTLELYYEKGTGSATFDNISMKAKGPKDSEHPQPVTTQIEESVNTALNKNYVFNKADYQYTLTNPSLGKIVGGILYPNATGSTTVKISDKSGKIIKEVPLSVTASTEDKFTKLLDKWNDVTIGNHVYDTNDSNMQKINQKLDETNAKNIKTIKLDSNHTFLWKDLDNLNNSAQLTATYRRLEDLAKQITNPHSTIYKNEKAIRTVKESLAWLHQNFYNVNKDIEGSANWWDFEIGVPRSITATLALMNNYFTDAEIKTYTDPIEHFVPDAGYFRKTLDNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKMLNDSTVATKPLKSNLSTFNSMDRLAYYNAEKDFGFALSLHSKRTLNYEGMNDENTRDWYTGDGMFYLYNSDQSHYSNHFWPTVNPYKMAGTTEKDAKREDTTKEFMSKHSKDAKEKTGQVTGTSDFVGSVKLNDHFALAAMDFTNWDRTLTAQKGWVILNDKIVFLGSNIKNTNGIGNVSTTIDQRKDDSKTPYTTYVNGKTIDLKQASSQQFTDTKSVFLESKEPGRNIGYIFFKNSTIDIERKEQTGTWNSINRTSKNTSIVSNPFITISQKHDNKGDSYGYMMVPNIDRTSFDKLANSKEVELLENSSKQQVIYDKNSQTWAVIKHDNQESLINNQFKMNKAGLYLVQKVGNDYQNVYYQPQTMTKTDQLAI

SEQ ID NO: 74 - protein, 807 aa, Staphylococcus aureus; identical to SEQ ID NO: 33
  Staphylococcus aureus subsp. aureus COL hyaluronate lyase

SEQ ID NO: 75 - protein, 420 aa, Staphylococcus aureus
  Staphylococcus aureus strain MRSA252 hyaluronate lyase 2
MTYRMKKWQKLSTITLLMAGVITLNGGEFRSIDKHQIAVADTNVQTTDYEKLRNIWLDVNYGYDKYDENNPDMKKKFEATENEAEKLLKEMKTESDRKYLWESSKDLDTKSADMTRTYRNIEKISEAMKHKNTKLKTDENKTKVKDALEWLHKNAYGKEPDKKVADLTSNFKNKTSRNTNLNWWDYEIGTPRALTNTLILLQEDFTDEEKKKYTAPIKTFAPDSDKILSSVGKSEPAKGGNLVDISKVKLLESIIEEDKDMMKKSIDSFNTVFTYAQNSATGKERNGFYKDGSYIDHQDVPYTGAYGVVLLEGISQMMPMIKETPFNDSNQNDTTLKSWIDDGFMPLIYKGEMMDLSRGRAISRENETSHSASATVMKSLLRLSDTMDKSTKAKYKKIVKTSVESDSSYKQTDYLSSYSD

SEQ ID NO: 76 - protein, 806 aa, Staphylococcus aureus
  Staphylococcus aureus strain MRSA252 hyaluronate lyase 1
MTNKMKKWQKLSTITLLMTGVIALNNGEFRNVDKHQIAVADTNVQTPDYEKLKKTWLDVNYGYDQYDENNQDMKKKFDAKEKEAKKLLDDMKTDTNRTYLWSGAENLETNSSHMTKTYRNIEKIAESMQHKNTVLKTVENKLKIKEALDWMHKNVYGKNPSQKVEDLTKNRKGQTTPKNNSLNWWDYEIGTPRALTNTLLLMDDMLTKDEMKNYSKPISTYAPSSDKILSSVGESEDAKGGNLVDISKVKLLESVIEEDVDMLKKSIDSFNKVFTYVQDSATGKGRNGFYKDGSYIDHQDVPYTGAYGVVLLEGISQMMPMIKESPFKTTQDNATLSNWIDEGFMPLIYKGEMMDLSRGRAISRENETSHTASATVMKSLLRLNDTMDDSTKTRYKQIVKTSVNSDSSYNQNNYLNSYSDIAKMKKLMNDSTISKNDLTQQLKIYNDMDRVTYHNKDLDFAFGLSMTSKNIARYENINGENLKGWHTGAGMSYLYNSDVKHYRDNFWATADMTCLPGTTTLNDMPSTNTKNDKSFVGGTKLNNKYASIGMDFENQDKTLTAKKSYFILNDKIVFLGTGIKSTDSSKNPVTSVENRKANGYKLFKDDIEITTSDVNAQETHSVFLESNDTKKNIGYHFLDKPKITVKKESHTGKWSEINKSQKKDDKKDEYYEVTQTHNTSDSKYAYVLYPGLSKSDFKSKNNNVSIVKQDEDFHVIKDNDGVFAGVNYSDNTKSFDINGITVELKEKGMFVIKKKDDKAYKCSFYNPETTNTASNIESKIFIKGYTITNKSVINSNDAGVNFELTK

SEQ ID NO: 77 - protein, 815 aa, Staphylococcus aureus
  Staphylococcus aureus subsp. aureus MW2 hyaluronate lyase precursor
MTYRIKKWQKLSTITLLMAGVITLNGGEFRSIDKYQIAVADTNVQTPDYEKLRNTWLDVNYGYDKYDEKNDAMKKKFEATENEAKKLLSEMKTESDRKYLWENSKDLDTKSADMTRTYRNIEKIAEAMKHKDTKLKIDENKKKVKDALEWLHKNAYGKEPDKKVADLTSNFKNKTSRNTNLNWWDYEIGTPRALTNTLILLNDQFSNDEKKKYTAPIKTFAPESDKILSSVGQPEQAKGGNLVDIAKVKLLESIIEEDKDITKNSIDAFNKVFTYVQSNATGKERNGFYKDGSYIDHQDVPYTGAYGVVLLEGISQMMPMIKETPFNDKTQNDTTLKSWIDDGFMPLIYKGEMMDLSRGRAISRENETSHTASATVMKSLLRLSDAMDDSTKAKYKQIVKTSVKSDSSYGQNDTLSSYSDISKMKSLMEDSTISTNGLTQQLKIYNDMDRVTYHNKDLDFAFGLSMTSKNVARYESINGENLKGWHTGAGMSYLYNSDVKHYRDNFWATADMKRLAGTTTLENEEPKGTDVKKSSKTFVGGTKFDDQHASIGMDFENQDKTLTAKKSYFILNDKIVFLGTGIKSTDSSKNPVTTIENRKANGYTLYTDDKQTTASDNQGTNSVFLESTNKPKNNIGYHFLNESKITVKKESHTGKWSDINKSQKQDSKTNQYYEVTQKHSNTDSKYAYVLYPGLSKDDFNTKKDKVTVVKQDDDFHVVKDNESVWAGVNYSDSTQTFIINNTKVEVKAKGMFILKKKDDKTYECSFYNPESTNTASDIESKISMTGYSITNKNTSTSNESGVRFELQQTLNKDDN

SEQ ID NO: 78 - protein, 807 aa, Staphylococcus aureus; identical to SEQ ID NO: 33
  Staphylococcus aureus subsp. aureus COL hyaluronate lyase

SEQ ID NO: 79 - protein, 809 aa, Staphylococcus aureus
  Staphylococcus aureus RF122 hyaluronate lyase
MTYRMKKWQKLSTITLLMAGGITFNDSEFRSVDKHQIAVADTNVQTPNYEKLKNTWLDVNYGYDKYDESNPDMKKKFEATEKEARKLLSEMKTESDRKYLWENSKDLDTKSADMTRTYRNIEKIAEAMKHPKTTLKNDENKKKVKDALEWLHKNAYGKEPGKKVADLKTNFSKSAPQKNTNLNWWDYEIGTPRALTNTLILLKEDFTDEEKKKYTAPIKTFAPKSDEILSSVGKAEPAKGGNLVDISKVKLLESIIEEDKDMMKNSIDSFNKVFTYVQDSATDKERNGFYKDGSYIDHKDVPYTGAYGVVLLEGISQMMPMIKETPFNDKTQNNTTLTSWIDDGFMPLIYKGEMMDLSRGRAISRENETSHSASATVMKSLLRLSDAMDESTKAKYKQIVKNSVKSDSSYGQNDTLSSYSDIDKMKSLMTDSTISTNGLTQQLKIYNAMDRVTYHNKDLDFAFGLSMTSKNVARYENINGENLKGWHTGAGMSYLYNSDVRHYRDNFWATADMKRLADTTTLENEEPKGTDVKKSSKTFVGGTKFDDQHASIGMDFENQDKTLTAKKSYFILNDKIVFLGTGIKTTDSSKNPVTTIENRKAHGYTLYTDDKQTTNSNNQETNSVFLESTNSTQNNIGYHFLNKSKITVKKESHTGKWSDINKSQKDTQKTDEYYEVTQKHSNTDDKYAYVLYPGITKDNFKSKASQVTVVKQDDDFHVVKDNESVWAGVNYSDSTQTFDINGTKVEVKAKGMFILKKKDDNTYECSFYNPESTNSASDIESKISMTGYSITNKNTSNTNESGVRFELTK

SEQ ID NO: 80 - protein, 807 aa, Staphylococcus aureus
  Staphylococcus aureus RF122 hyaluronate lyase precursor
MTYKMKKWQKLSTITLLMAGVITLNNGEFRNVDKHQIAVADTNVQTPDYEKLKKTWLDVNYGNDQYDENNQDMKKKFDAKENEAKKLLEDMKTDTNRTYLWSGAENLETNSSHMTKTYRNIEKIAEAMRHKNTSLKTDENKLKIKDAIKWLHHNVYGKDPDKKVADLTTNRKEKDSSKKNNSLNWWDYEIGTPRALTNTLLLMDNMLTKDEMKNYSKPISIYSPSSYKILSSVGESEDAKGGNLVDIAKVKFLESVIEEDVDMMKKSIDSFNKVFTYVQDSATGKARNGFYKDGSYIDHQDVPYTGAYGVVLLEGISQMMPMIKESPFKHTQDKATLSNWIDEGFMPLIYKGEMMDLSRGRAISRENETSHTASATVMKSLLRLSDTMDESTKTKYKQIVKTSVKSDSSYDSNDTLNSYSDIDKMKKLMNDSTISKNDLTQQLKIYNDMDRVTYHNKELDFAFGLSMTSKNIARYENINGENLKGWHTGAGMSYLYNSDVKHYRDNFWATADMTRLPGTTTLNDMPSTNTKNDKSFVGGTKLNNKYASIGMDFENQDKTLTAKKSYFILNDKIVFIGTGIKSTDSSKNPVTSVENRKANGYKLFKGDIEITTSDVNAQETHSVFLESNDTKKNIGYHFLDKPKITVKKESHTGKWSEINKSQKTDDKKDEYYEVTQTHNTSDSKYAYVLYPGLSKSDFKSKNNNVSIVKQDEDFHVIKDNDGVFAGVNYSDSTKSFDINGTIVELKEKGMFVIKKKDDNTYECSFYNPTSTNSTSNKESKISVTGYTITNQSVSNFKESDIHFELTK

SEQ ID NO: 81 - protein, 807 aa, Staphylococcus aureus; identical to SEQ ID NO: 33
  Staphylococcus aureus subsp. aureus USA300_TCH1516 hyaluronate lyase

SEQ ID NO: 82 - protein, 1066 aa, Streptococcus pneumoniae
  Streptococcus pneumoniae hyaluronidase
MQTKTKKLIVSLSSLVLSGFLLNHYMTIGAEETTTNTIQQSQKEVQYQQRDTKNLVENGDFGQTEDGSSPWTGSKAQGWSAWVDQKNSADASTRVIEAKDGAITISSHEKLRAALHRMVPIEAKKKYKLRFKIKTDNKIGIAKVRIIEESGKDKRLWNSATTSGTKDWQTIEADYSPTLDVDKIKLELFYETGTGTVSFKDIELVEVADQLSEDSQTDKQLEEKIDLPIGKKHVFSLADYTYKVENPDVASVKNGILEPLKEGTTNVIVSKDGKEVKKIPLKILASVKDAYTDRLDDWNGIIAGNQYYDSKNEQMAKLNQELEGKVADSLSSISSQADRTYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQCLQSLVKTIVQSDSYYDVFKNLKTYKDISLMQSLLSDAGVASVPRPSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESGNPYKVYVNDKEASLTEQEKDYPETQSVFLESFDSKKNIGYFFFKKSSISMSKALQKGAWKDINEGQSDKEVENEFLTISQAHKQNRDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 83 - protein, 1078 aa, Streptococcus pneumoniae
  Streptococcus pneumoniae strain ATCC BAA-255 / R6 hyaluronate lyase
MILQYVYWSVYMQTKTKKLIVSLSSLVLSGFLLNHYMTVGAEETTTNTIQQSQKEVQYQQRDTKNLVENGDFGQTEDGSSPWTGSKAQGWSAWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQPSEDSQTDKQLEEKIDLPIGKKHVFSLADYTYKVENPDVASVKNGILEPLKEGTTNVIVSKDGKEVKKIPLKILASVKDTYTDRLDDWNGIIAGNQYYDSKNEQMAKLNQELEGKVADSLSSISSQADRIYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 84 - protein, 1067 aa, Streptococcus pneumoniae
  Streptococcus pneumoniae serotype 2, strain D39 / NCTC 7466 hyaluronate lyase
MQTKTKKLIVSLSSLVLSGFLLNHYMTVGAEETTTNTIQQSQKEVQYQQRDTKNLVENGDFGQTEDGSSPWTGSKAQGWSAWVDQKNSSADASTRVIEAKDGAITISSPEKLRAAVHRMVPIEAKKKYKLRFKIKTDNKVGIAKVRIIEESGKDKRLWNSATTSGTKDWQTIEADYSPTLDVDKIKLELFYETGTGTVSFKDIELVEVADQPSEDSQTDKQLEEKIDLPIGKKHVFSLADYTYKVENPDVASVKNGILEPLKEGTTNVIVSKDGKEVKKIPLKILASVKDTYTDRLDDWNGIIAGNQYYDSKNEQMAKLNQELEGKVADSLSSISSQADRIYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQRLQSLVKTIVQSDSYYDVFKNLKTYKDISLMQSLLSDAGVASVPRTSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESSNPYKVYVNDKEASLTEQEKDYPETQSVFLESSDSKKNIGYFFFKKSSISMSKALQKGAWKDINEGQSDKEVENEFLTISQAHKQNGDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 85 - protein, 805 aa, Streptococcus pyogenes
  Streptococcus pyogenes serotype M1, strain GAS extracellular hyaluronate lyase
MNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIKADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTGLSDDAFVASKKLNNTSALAAMTFTNWNKSLTLNKGWFILGNKIIFVGSNIKNQSSHKAYTTIEQRKENQKYPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYGKKATMFSNHNLSHQGFYSFPHPVRQNQQ

SEQ ID NO: 86 - protein, 780 aa, Streptococcus pyogenes
  Streptococcus pyogenes serotype M2, strain MGAS10270 hyaluronate lyase precursor
MVYFYLVNQSTFIISFLYWRNVSVNTYFCTHHKQLLLYSNLFLSFAMIGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASTNITKTYRNIEKIAKQITNPESCYYQDSKAIAIVKDGMAFMYEHAYNLNRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNTQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLELKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPRTLSISKALQTGKWQNIKADDKSPEAIKEVSNTFITIMQNHTQEGDRYAYMMLPNMTRQEFETYISKLDIDLLENN

SEQ ID NO: 87 - protein, 868 aa, Streptococcus pyogenes
  Streptococcus pyogenes serotype M4, strain MGAS10750 hyaluronate lyase precursor
MNTYFCTHHKQLLLYSNLFLSFAMMGQGTAIYADTLTSNSKPNNTYFQTQTLTTTDSEKKVVQPQQKDYYTELLDQWNSIIAGNDAYDKTNPDMVTFHNKAEKDAQNIIKSYQEPDHENRTYLWEHAKDYSASANITKTYRNIEKIAKQITNPESCYYQDSKAIAIVKDGMAFMYEHAYNLDRENHQTTGKENKENWWDYEIGTPRAINNTLSLMYPYFTQEEILKYTAPIEKFVPDPTRFRVRAANFPPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNVFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATTFSNHNLSHQGFYSFPHPVKQNQQQKLAHQGIAAKNNALNSHKIPHKRQRRLPRTGYQSSSLEFLGGALVASFNHITKPFRKKDLRI

SEQ ID NO: 88 - protein, 828 aa, Streptococcus pyogenes
  Streptococcus pyogenes serotype M6, strain MGAS10394 hyaluronate lyase precursor
MVYFYLVDQFTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASTNITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTFVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTDYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 89 - protein, 556 aa, Streptococcus pyogenes
  Staphylococcus aureus subsp. aureus strain MRSA252 hyaluronan lyase 2
MVYFYLVNQSTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLGNMQRIIPLLLISRKLTAILKKISKMKSLMEDSTISTNGLTQQLKIYNDMDRVTYHNKGLDFAFGLSMTSKNVARYESINGENLKGWHTGAGMSYLYNSDVKHYRDNFWATADMKRLAGTTTLDNEEPKSTDVKKSSKTFVGGTKFDDQHASIGMDFENQDKTLTAKKSYFILNDKIVFLGTGIKSTDSSKNPVTTIENRKANDYKLYKDDTQTTNSDNQETNSLFLESTNSTQNNIGYHFLNESKITVKKESHTGKWSDINKSQKDIQKTDEYYEVTQKHSNTDSKYAYVLYPGLSKDVFKSKASKVTVVKQEDDFHVVKDNESVWAGINYSDSAKTFEINNTKVEVKAKGMFILTKKDDNTYECSFYNPESTNSVSDIESKISMTGYSIINKNTSTSNESGVRFELTK

SEQ ID NO: 90 - protein, 635 aa, Streptococcus pyogenes
  Streptococcus pyogenes strain MGAS9429 hyaluronate lyase precursor
MAFMYEHAYNLNRENHQTTGKENKENWWVYEIGTPRAINNTLSLMYPYFTQEEILKYTAPIEKFVPDPTRFRVRAANFSPFEASSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 91 - protein, 828 aa, Streptococcus pyogenes
  Streptococcus pyogenes serotype M12, strain MGAS9429 hyaluronate lyase precursor
MVYFYLVNQSTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYVKTNPDMVTFHNKAEKDAQNIIKSYQGPDHENRTYLWEHAKDYSASTNITKTYRNIEKIAKQITNPESCYYQDSKAIAIVKDGMAFMYEHAYNLNRENHQTTGKENKENWWVYEIGTPRAINNTLSLMYPYFTQEEILKYTAPIEKFVPDPTRFRVRAANFSPFEASSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 92 - protein, 828 aa, Streptococcus pyogenes
  Streptococcus pyogenes serotype M28, strain MGAS6180
MVYFYLVNQFTFIISFLYRRNLSVNTYFCTHHKQLLLYSNLFLSFAMMGQGTAIYADTLTSNSEPNNTYFQTQMLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSSIEADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTSLSDDAFVASKKLNNTSALAAMTFTNWNKSLTLNKGWFILGNKIIFVGSNIKNQSSHKAYTTIEQRKENQKHPYHAYVNNQPVDLNNQLVDFTNTKSIFLESDDSAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYEKKATMFSNHNLSHQGFYSFPHPVKQNQQ

SEQ ID NO: 93 - protein, 522 aa, Streptococcus suis
  Streptococcus suis 05ZYH33 hyaluronidase
MGFFISQSKQHYGIRKYKVGVCSALIALSILGTRVAANQLPSTETASPQSSQLVETTPETTEAVNLTTEAVMTSEVSSEVSPVTSTETQPSSTAAETLASPQAVQATKEEEKNLVANGEFASTTAASGNWADPAATNWETWIPANVKKENGQVRIDEGRLHISSTASYRVAVHQTVDVDPNKRYLFSYNVETKDLKGSGVRVRLRSLTAEGKDLSPQEFAYTPYKNGSQAEHIEQILTVSPETRKLKVELFFENSVGQAWLDNISLVEYVEKTPETPEPSLELVQPETGQISLASNKVYLPVRPDLTYRIADAAVAIVEKNMIRPLAAGKTQVDVYDKDTKLSSFELTVTEHQATVFDTLRNNWEDISLANKRYQSNDTQMKAFLGRLDAGVASSLKKWVEPTNQGKTIFNDIDFSKSSHLTTVYRRLEQMAQVVENPDSAYYHDRSLIDLVRKGMNWLYTNVYNENKSIDGNWWDYEIGTPRAVVNTLIYMHPYFSQEEILTYTKPISKFVPDPTTISVKH

SEQ ID NO: 94 - protein, 1164 aa, Streptococcus suis
  Streptococcus suis hyaluronidase
MGFFISQSKQHYGIRKYKVGVCSALIALSILGTRVAANQLPSTETASPQSSQLVETTPETTEAVMTSEVSSEVSPVTSTETQPSSTTAETLASPQAVQATKEEKNLVANGEFISTTAPSGNWKELAATNWETWIPANVKKENGQVRIDEGRLHISSTASYRVAVHQTVDVDPNKRYLFSYDVETKDLKGSGVRVRLRSLTAEGKDLSPQEFAYTPYKNGSQAEHIEQILTVSPETRKLKVELFFENSVGQAWLDNISLVEYVEKTPETPEQSPELVQPETGQISLASNKVYLPVRPDLTYRIADAAVATVEKNMIRPLAAGKTQVDVYDKDTKLSSFELIVTEHQATVFDTLRNNWEDISLANKRYQSNDAQMKAFLGRLDAGVASSLEKWVEPTEQSKTIFNDIDFSKSSHLTTVYRRLEQMAQVVENPDSAYYHDRSLIDLVRKGMNWLYANVYNENKSIDGNWWDYEIGTSRAVVNTLIYMHPYFSQEEILTYTKPISKFVPDPTTIRKTLTNPVPAVGGNQTDLSKVAILEGALREDADRVRAGAQGLTTIMKFVDKGEGFYRDGSFIDHTNVAYTGAYGNVLIEGFSQLLPVIQPTEFALKEEQTNILYEWIEKAFMPILVRGELMDMTRGRSISRATGESHVQAMEILRSLVRIAESAQPEQKTKLLSFVKAQLTSDTFYDSYRSLKSYKDIDLVNKLLADNQIPAEVDKDYIAAFNNMDKFVYRSAQEGFTFALSMYSSRTQNYEDMNNENRKGWYTADGMVYLYNDDLSHYSNHYWATVDPYRLPGTTTTKDKREDGSGEVTLASDFVGASQLGNRLATIAMDFNNWNNSLTARKAWIVLGNKIVFLGTDIQHQSAQGAETTIENRKLLTGEKYSYYINGQPVDLSKEVVTDKTQSFYMTNGKDNQSIGYVFLNQLPTHAKLDQRTGKWSDINYNQSKEEVSNSFVSLWHEHAQTSSNYAYVLVPNQSMEKVNQAAASVKLLHQDRDLQVVYDQEQNVWGVVKYTDTAYKLTDDITLTDAGLYTIQKVEGGYRIAFYNPSTRTVKNGIELTKAGSSLTVEMEPTAAYPSTVWKVTMPEGSDKQTGSVEKTEKEEKQLKENQPSSEVKQVVHHAAEKTKPSKPRLPQTGEEASLGLGFLGLLTLGAVVDFKCRRSHS

SEQ ID NO: 95 - protein, 1164 aa, Streptococcus suis
  Streptococcus suis ST3 hyaluronidase
MGFFISQSKQHYGIRKYKVGVCSALIALSILGTRVAANQLPSTETASPQSSQLVETTPETTEAVMTSEVSSEVSPVTSTETQPSSTTAETLASPQAVQATKEEKNLVANGEFISTTAPSGNWKELAATNWETWIPANVKKENGQVRIDEGRLHISSTASYRVAVHQTVDVDPNKRYLFSYDVETKDLKGSGVRVRLRSLTAEGKDLSPQEFAYTPYKNGSQAEHIEQILTVSPETRKLKVELFFENSVGQAWLDNISLVEYVEKTPETPEQSPELVQPETGQISLASNKVYLPVRPDLTYRIADAAVATVEKNMIRPLAAGKTQVDVYDKDTKLSSFELIVTEHQATVFDTLRNNWEDISLANKRYQSNDAQMKAFLGRLDAGVASSLEKWVEPTEQSKTIFNDIDFSKSSHLTTVYRRLEQMAQVVENPDSAYYHDRSLIDLVRKGMNWLYTNVYNENKSIDGNWWDYEIGTPRAVVNTLIYMHPYFSQEEILTYTKPISKFVPDPTTIRKTLTNPVPAVGGNQTDLSKVAILEGALREDADRVRAGAQGLTTIMKFVDKGEGFYRDGSFIDHTNVAYTGAYGNVLIEGFSQLLPVIQPTEFALKEEQTNILYEWIEKAFMPILVRGELMDMTRGRSISRATGESHVQAMEILRSLVRIAESAQPEQKTKLLSFVKAQLTSDTFYDSYRSLKSYKDIDLVNKLLADNQIPAEVDKDYIAAFNNMDKFVYRSAQEGFTFALSMYSSRTQNYEDMNNENRKGWYTADGMVYLYNDDLSHYSNHYWATVDPYRLPGTTTTKDKREDGSGEVTLASDFVGASQLGNRLATIAMDFNNWNNSLTARKAWIVLGNKIVFLGTDIQHQSAQGAETTIENRKLLTGEKYSYYINGQPVDLSKEVVTDKTQSFYMTNGKDNQSIGYVFLNQLPTHAKLDQRTGKWSDINYNQSKEEVSNSFVSLWHEHAQTSSNYAYVLVPNQSMEKVNQAAASVKLLHQDRDLQVVYDQEQNVWGVVKYTDTAYKLTDDITLTDAGLYTIQKVEGGYRIAFYNPSTRTVKNGIELTKAGSSLTVEMEPTAAYPSTVWKVTMPEGSDKQTGSVEKTEKEEKQLKENQPSSEVKQVVHHAAEKTKPSKPRLPQTGEEASLGLGFLGLLTLGAVVDFKCRRSHS

SEQ ID NO: 96 - protein, 802 aa, Vibrio fischeri
  Vibrio fischeri strain ATCC 700601/ES114 hyaluronate lyase precursor
MYMIKKHRLNTIALSMLFLFTGNAYAAKNTQTPQYLPSDFEQVRENWAENYLGDPAITFDQTLKNMVTSTNSSAQKHWDSMTPQPNASGIWDDLPLIDKDTTLGPNIRNSYQRLFTMAKAYRLRDGNLENNQLMLNDIMTAMNYINQNFYFVNQLEYGNWWQWELAIPKDIHNILVLLFDDIKDNYQTIITNHLNATRYFTPDPTHLGVSPGAAESTNPNYRESTGGNRTDNAQVVLIRGMLENNSEEISQAIAALPAVIEYVSEGDGYYTDGSFLQHSDIAYNGTYGNVLLGGLGIQMNAVAGSPWSMDNQTISNVYNIINQSYEPLLYKGAMMDMVNGRSISRSAEQNHDVGLNIVNSMLFYTNGPDSDKNKQLSSLIKTQITDDTYQNFFDKIYYVSTYQAAQHIVNDPTVSLKDPLIGNFSYPSMDRIVHRRTDWAFALAMHSYRIGNYECMNGENLKGWFTGDGMIYLYNDQLDHYTGYWPTVNASRMPGTTVDSQIMADCSGERVGGNVNTNMQWVGSTSLNNYGIAGMQFYNWSDTLSAYKSWFMFDNEVVMLGSNIKDQSNANNITTIENRKRLAETKLFIDGTEQAALPYQGAPATFSIRNKTLANSDLSYVMLTPKTISISQNDVDGNWSDIGNSKGDVSDSYLQATLTQVDQADYQYALLPNQNNDTVQNYAQHPDVTVLRQDEQAHAVQENTLNIIAANNWKNNPVNITDTITLNSMMGFMIKEESSNTFTVAVSEPIQTIDSVNFTFDKQGIVIKEDIENRVVLNGTTLTINTSGLQGQSYSFQVTIQD

SEQ ID NO: 97 - protein, 517 aa, Synechococcus sp.
  Synechococcus sp. RCC307 neutral invertase-like protein
MGAPAIPKVPRSPSKSEHTTRPNSGESEVVRQAEELFEQTLVNVRGQLAGAVAALESSVHDSELNYGEIFLRDNVPVMVYLLLRGRFEIVRHFLDLCLELQSRSYRTRGVFPTSFVEEDDKILADYGQRSIGRITSVDASLWWPVLCWMYVRASGDTSYGTSPKVQRAVQLLLDLVLQPSFYEPPVLFVPDCAFMIDRPMDVWGAPLEVEVLLFGCLKSCCQLMSLVEGGGHGGPLIQQRLELTRTWMRDLRVYLLNHYWVTSKTMQVLRRRPTEQYGDYQSRNEFNVQPEVIPHWLQEWLDDRGGYLIGNMRTGRPDFRFYSLGNALGSLFGLLTGPQQLALFRLVIHNRQHLMAEMPMRICHPPMDQDEWITNTGMDPKNWPWSYHNGGHWPSLLWPMAAAVLMHQRLYPNDDLLLLGQTRTMLEECYWQQLNQLPRQQWAEYFDGPTGTWVGQQARINQTWTIVGFLLLHHLMRKAPQDVKLLDLDDVGPLRLSFQDQHEKSSTDERKSFLKNY

SEQ ID NO: 98 - protein, 1021 aa, Proteus vulgaris
  Proteus vulgaris chondroitin-sulfate-ABC endolyase
MPIFRFTALAMTLGLLSAPYNAMAATSNPAFDPKNLMQSEIYHFAQNNPLADFSSDKNSILTLSDKRSIMGNQSLLWKWKGGSSFTLHKKLIVPTDKEASKAWGRSSTPVFSFWLYNEKPIDGYLTIDFGEKLISTSEAQAGFKVKLDFTGWRAVGVSLNNDLENREMTLNATNTSSDGTQDSIGRSLGAKVDSIRFKAPSNVSQGEIYIDRIMFSVDDARYQWSDYQVKTRLSEPEIQFHNVKPQLPVTPENLAAIDLIRQRLINEFVGGEKETNLALEENISKLKSDFDALNIHTLANGGTQGRHLITDKQIIIYQPENLNSQDKQLFDNYVILGNYTTLMFNISRAYVLEKDPTQKAQLKQMYLLMTKHLLDQGFVKGSALVTTHHWGYSSRWWYISTLLMSDALKEANLQTQVYDSLLWYSREFKSSFDMKVSADSSDLDYFNTLSRQHLALLLLEPDDQKRINLVNTFSHYITGALTQVPPGGKDGLRPDGTAWRHEGNYPGYSFPAFKNASQLIYLLRDTPFSVGESGWNNLKKAMVSAWIYSNPEVGLPLAGRHPFNSPSLKSVAQGYYWLAMSAKSSPDKTLASIYLAISDKTQNESTAIFGETITPASLPQGFYAFNGGAFGIHRWQDKMVTLKAYNTNVWSSEIYNKDNRYGRYQSHGVAQIVSNGSQLSQGYQQEGWDWNRMEGATTIHLPLKDLDSPKPHTLMQRGERGFSGTSSLEGQYGMMAFNLIYPANLERFDPNFTAKKSVLAADNHLIFIGSNINSSDKNKNVETTLFQHAITPTLNTLWINGQKIENMPYQTTLQQGDWLIDSNGNGYLITQAEKVNVSRQHQVSAENKNRQPTEGNFSSAWIDHSTRPKDASYEYMVFLDATPEKMGEMAQKFRENNGLYQVLRKDKDVHIILDKLSNVTGYAFYQPASIEDKWIKKVNKPAIVMTHRQKDTLIVSAVTPDLNMTRQKAATPVTINVTINGKWQSADKNSEVKYQVSGDNTELTFTSYFGIPQEIKLSPLP

SEQ ID NO: 99 - protein, 684 aa, Pedobacter heparinus
  Pedobacter heparinus DSM 2366 chondroitin AC lyase
PALLIAQQTGTAELIMKRVMLDLKKPLRNMDKVAEKNLNTLQPDGSWKDVPYKDDAMTNWLPNNHLLQLETIIQAYIEKDSHYYGDDKVFDQISKAFKYWYDSDPKSRNWWHNEIATPQALGEMLILMRYGKKPLDEALVHKLTERMKRGEPEKKTGANKTDIALHYFYRALLTSDEALLSFAVKELFYPVQFVHYEEGLQYDYSYLQHGPQLQISSYGAVFITGVLKLANYVRDTPYALSTEKLAIFSKYYRDSYLKAIRGSYMDFNVEGRGVSRPDILNKKAEKKRLLVAKMIDLKHTEEWADAIARTDSTVAAGYKIEPYHHQFWNGDYVQHLRPAYSFNVRMVSKRTRRSESGNKENLLGRYLSDGATNIQLRGPEYYNIMPVWEWDKIPGITSRDYLTDRPLTKLWGEQGSNDFAGGVSDGVYGASAYALDYDSLQAKKAWFFFDKEIVCLGAGINSNAPENITTTLNQSWLNGPVISTAGKTGRGKITTFKAQGQFWLLHDAIGYYFPEGANLSLSTQSQKGNWFHINNSHSKDEVSGDVFKLWINHGARPENAQYAYIVLPGINKPEEIKKYNGTAPKVLANTNQLQAVYHQQLDMVQAIFYTAGKLSVAGIEIETDKPCAVLIKHINGKQVIWAADPLQKEKTAVLSIRDLKTGKTNRVKIDFPQQEFAGATVELK

SEQ ID NO: 100 - protein, 844 aa, Victivallis vadensis
  Victivallis vadensis ATCC BAA-548 chondroitin AC lyase
MHRKIVFPLFVLLFTAFAAFAASQPQWKWRQSKYCRITEHAGKKLLTVAIPADAPEISRRNTADTPVGLTCFEGQPIEFSIRLRNSGISRPDNLHNGIKFQLYFRDGNGTERWTQAEIPHEPFPWRRFRFSERIPADATSGTLRLGLQGSSGNVEFDLDSLQIRPLDPELSPVPPTPEQIRECELIESRLRAGLPAQQPPPGPEVKKLLERQNGDGTFRDLDYSARNRSIWPAARHLKRTFELALARATPGHALYRDPAAGEAVRKAVAWWAERQPQNGNWWWNDMYVPKILGNILLLSPELFPDGPRRRAALNVCRQACFLSRYTGNNRVFIAANIFCRALLERNLPVMDRAAAVLSEEIRFAPAEHKTAWSFGGIRADGCYHQHGPQIQFGNYGGEFLANIAYWSNILKETHWELSPEQWRIMRHLTFNGFQWVLWRGRMDLLACGRQLGRNAAETKGERTLNAFAQLRNADPGDRAPYDAALRRNRDGENTLTGNRHFWNSDYMVHRRPTWYASVRMNSVRVRPIEDDTNWDNALGRYFSDGACLVMRSGREYENITACWDWTRLPGTTLPKTPVYTGEDARRFGLKIGGGDLPRWTHSRNWRQLGETGFVGGVTDGERGAAVYTQDLDGVRARKAWFFDRDAIYCLGSGITSTSPYEVATTVNSCLRNGEIQQGDGWFRHDGIGYRGENLKLTAGPRTGDWRYVEGGLTRPVPETKELFTLTVEHGVKPRNASYIYTILPGATPEETAGTPPGRVLRNTPECQAVEFADGVRAAIFYEPGRLDDFETDTPGVFLIGKGTVHAADPTGRHSSFTLKLNGVSRKVPLPAGEFAGQSVKIVLK

SEQ ID NO: 101 - protein, 510 aa, Pan troglodyte
  Chimpanzee PH20
MGVLKFKHIFFRSFVKSSGVSQIVFTFLLIPCCLTLNFRAPPVIPNVPFLWAWNAPSEFCLGKFDEPLDMSLFSFIGSPRINVTGQDVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVQEAIRVSKIPDAKSPLPVFVYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEESQIFYNASPSTLSATMFIDLCDLYLVPTSYLIL

SEQ ID NO: 102 - protein, 512 aa, Macaca mulatta
  Rhesus Monkey PH20
MGVLKFKHIFFRSFVKSSGVSQIVFTFLLIPCCLTLNFRAPPIIPNVPFLWAWNAPSEFCLGKFNEPLDMSLFTLMGSPRINITGQGVTIFYVDRLGYYPYIDLTTGVTVHGGIPQKVSLQDHLDKSKQDILFYMPVDNLGMAVIDWEEWRPTWARNWKPKDVYKNRSIELVQQQNVQLSLPQATDKAKQEFEKAGKDFMLETIKLGRSLRPNHLWGYYLFPDCYNHHYRKPGYNGSCFDVEIKRNDDLSWLWNESTALYPSIYLNTQQSVVVATLYVRNRVREAIRVSKIPDAKNPLPVFVYARLVFTDQVLKFLSREELVSTLGETVALGASGIVIWGSLSITRSMKSCLLLDTYMETILNPYIINVTLAAKMCSQVLCQEQGVCIRKDWNSSDYLHLNPDNFDIRLEKGGKFTVHGKPTVEDLEEFSEKFYCSCYTNLSCKEKADVKDTDAVDVCIADGVCIDASLKPPVETEGSPPIFYNTSSSTVSTTMFIWRLEVWDQGISRIGFF

SEQ ID NO: 103 - protein, 505 aa, Homo sapiens
  precursor soluble human PH20, amino acid residues 1-505
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISS

SEQ ID NO: 104 - protein, 503 aa, Homo sapiens
  precursor soluble human PH20, amino acid residues 1-503
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLII

SEQ ID NO: 105 - protein, 501 aa, Homo sapiens
  precursor soluble human PH20, amino acid residues 1-501
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFL

SEQ ID NO: 106 - protein, 499 aa, Homo sapiens
  precursor soluble human PH20, amino acid residues 1-499
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIL

SEQ ID NO: 107 - protein, 497 aa, Homo sapiens
  precursor soluble human PH20, amino acid residues 1-497
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVS

SEQ ID NO: 108 - protein, 495 aa, Homo sapiens
  precursor soluble human PH20, amino acid residues 1-495
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFI

SEQ ID NO: 109 - protein, 493 aa, Homo sapiens
  precursor soluble human PH20, amino acid residues 1-493
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATM

SEQ ID NO: 110 - protein, 491 aa, Homo sapiens
  precursor soluble human PH20, amino acid residues 1-491
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSA

SEQ ID NO: 111 - protein, 489 aa, Homo sapiens
  precursor soluble human PH20, amino acid residues 1-489
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTL

SEQ ID NO: 112 - protein, 490 aa, Homo sapiens
  precursor soluble human PH20, amino acid residues 1-490
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 113 - protein, 487 aa, Homo sapiens
  precursor soluble human PH20, amino acid residues 1-487
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPS

SEQ ID NO: 114 - protein, 485 aa, Homo sapiens
  precursor soluble human PH20, amino acid residues 1-485
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNAS

SEQ ID NO: 115 - protein, 484 aa, Homo sapiens
  precursor soluble human PH20, amino acid residues 1-484
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNA

SEQ ID NO: 116 - protein, 476 aa, Homo sapiens
  precursor soluble human PH20, amino acid residues 1-476
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETE

SEQ ID NO: 117 - protein, 475 aa, Homo sapiens
  precursor soluble human PH20, amino acid residues 1-475
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMET

SEQ ID NO: 118 - protein, 474 aa, Homo sapiens
  precursor soluble human PH20, amino acid residues 1-474
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPME

SEQ ID NO: 119 - protein, 473 aa, Homo sapiens
  precursor soluble human PH20, amino acid residues 1-473
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPM

SEQ ID NO: 120 - protein, 472 aa, Homo sapiens
  precursor soluble human PH20, amino acid residues 1-472
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPP

SEQ ID NO: 121 - protein, 471 aa, Homo sapiens
  precursor soluble human PH20, amino acid residues 1-471
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKP

SEQ ID NO: 122 - protein, 470 aa, Homo sapiens
  precursor soluble human PH20, amino acid residues 1-470
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLK

SEQ ID NO: 123 - protein, 469 aa, Homo sapiens
  precursor soluble human PH20, amino acid residues 1-469
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFL

SEQ ID NO: 124 - protein, 468 aa, Homo sapiens
  precursor soluble human PH20, amino acid residues 1-468
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 125 - protein, 466 aa, Homo sapiens
  precursor soluble human PH20, amino acid residues 1-466
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCID

SEQ ID NO: 126 - protein, 465 aa, Homo sapiens
  precursor soluble human PH20, amino acid residues 1-465
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCI

SEQ ID NO: 127 - protein, 464 aa, Homo sapiens
  precursor soluble human PH20, amino acid residues 1-464
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVC

SEQ ID NO: 128 - protein, 462 aa, Homo sapiens
  precursor soluble human PH20, amino acid residues 1-462
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADG

SEQ ID NO: 129 - protein, 460 aa, Homo sapiens
  precursor soluble human PH20, amino acid residues 1-460
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIA

SEQ ID NO: 130 - protein, 458 aa, Homo sapiens
  precursor soluble human PH20, amino acid residues 1-458
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVC

SEQ ID NO: 131 - protein, 456 aa, Homo sapiens
  precursor soluble human PH20, amino acid residues 1-456
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVD

SEQ ID NO: 132 - protein, 454 aa, Homo sapiens
  precursor soluble human PH20, amino acid residues 1-454
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDA

SEQ ID NO: 133 - protein, 452 aa, Homo sapiens
  precursor soluble human PH20, amino acid residues 1-452
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDT

SEQ ID NO: 134 - protein, 450 aa, Homo sapiens
  precursor soluble human PH20, amino acid residues 1-450
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVK

SEQ ID NO: 135 - protein, 508 aa, Homo sapiens
  precursor soluble human PH20, amino acid residues 1-508
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVAS

SEQ ID NO: 136 - protein, 506 aa, Homo sapiens
  precursor soluble human PH20, amino acid residues 1-506
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSV

SEQ ID NO: 137 - protein, 504 aa, Homo sapiens
  precursor soluble human PH20, amino acid residues 1-504
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIIS

SEQ ID NO: 138 - protein, 502 aa, Homo sapiens
  precursor soluble human PH20, amino acid residues 1-502
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLI

SEQ ID NO: 139 - protein, 500 aa, Homo sapiens
  precursor soluble human PH20, amino acid residues 1-500
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILF

SEQ ID NO: 140 - protein, 498 aa, Homo sapiens
  HuPH20 precursor 1-498
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSI

SEQ ID NO: 141 - protein, 496 aa, Homo sapiens
  precursor soluble human PH20, amino acid residues 1-496
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIV

SEQ ID NO: 142 - protein, 494 aa, Homo sapiens
  precursor soluble human PH20, amino acid residues 1-494
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMF

SEQ ID NO: 143 - protein, 492 aa, Homo sapiens
  precursor soluble human PH20, amino acid residues 1-492
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSAT

SEQ ID NO: 144 - protein, 488 aa, Homo sapiens
  precursor soluble human PH20, amino acid residues 1-488
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPST

SEQ ID NO: 145 - protein, 486 aa, Homo sapiens
  precursor soluble human PH20, amino acid residues 1-486
  SIGNAL (1)...(35): signal sequence
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASP

SEQ ID NO: 146 - protein, 472 aa, Homo sapiens
  mature soluble human PH20, amino acid residues 36-507
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVA

SEQ ID NO: 147 - protein, 470 aa, Homo sapiens
  mature soluble human PH20, amino acid residues 36-505
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISS

SEQ ID NO: 148 - protein, 468 aa, Homo sapiens
  mature soluble human PH20, amino acid residues 36-503
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLII

SEQ ID NO: 149 - protein, 466 aa, Homo sapiens
  mature soluble human PH20, amino acid residues 36-501
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFL

SEQ ID NO: 150 - protein, 464 aa, Homo sapiens
  mature soluble human PH20, amino acid residues 36-499
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSIL

SEQ ID NO: 151 - protein, 462 aa, Homo sapiens
  mature soluble human PH20, amino acid residues 36-497
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVS

SEQ ID NO: 152 - protein, 460 aa, Homo sapiens
  mature soluble human PH20, amino acid residues 36-495
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFI

SEQ ID NO: 153 - protein, 458 aa, Homo sapiens
  mature soluble human PH20, amino acid residues 36-493
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATM

SEQ ID NO: 154 - protein, 456 aa, Homo sapiens
  mature soluble human PH20, amino acid residues 36-491
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSA

SEQ ID NO: 155 - protein, 454 aa, Homo sapiens
  mature soluble human PH20, amino acid residues 36-489
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTL

SEQ ID NO: 156 - protein, 455 aa, Homo sapiens
  mature soluble human PH20, amino acid residues 36-490
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 157 - protein, 452 aa, Homo sapiens
  mature soluble human PH20, amino acid residues 36-487
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPS

SEQ ID NO: 158 - protein, 450 aa, Homo sapiens
  mature soluble human PH20, amino acid residues 36-485
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNAS

SEQ ID NO: 159 - protein, 449 aa, Homo sapiens
  mature soluble human PH20, amino acid residues 36-484
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNA

SEQ ID NO: 160 - protein, 441 aa, Homo sapiens
  mature soluble human PH20, amino acid residues 36-476
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETE

SEQ ID NO: 161 - protein, 440 aa, Homo sapiens
  mature soluble human PH20, amino acid residues 36-475
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMET

SEQ ID NO: 162 - protein, 439 aa, Homo sapiens
  mature soluble human PH20, amino acid residues 36-474
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPME

SEQ ID NO: 163 - protein, 438 aa, Homo sapiens
  mature soluble human PH20, amino acid residues 36-473
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPM

SEQ ID NO: 164 - protein, 437 aa, Homo sapiens
  mature soluble human PH20, amino acid residues 36-472
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPP

SEQ ID NO: 165 - protein, 436 aa, Homo sapiens
  mature soluble human PH20, amino acid residues 36-471
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKP

SEQ ID NO: 166 - protein, 435 aa, Homo sapiens
  mature soluble human PH20, amino acid residues 36-470
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLK

SEQ ID NO: 167 - protein, 434 aa, Homo sapiens
  mature soluble human PH20, amino acid residues 36-469
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFL

SEQ ID NO: 168 - protein, 433 aa, Homo sapiens
  mature soluble human PH20, amino acid residues 36-468
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAF

SEQ ID NO: 169 - protein, 431 aa, Homo sapiens
  mature soluble human PH20, amino acid residues 36-466
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCID

SEQ ID NO: 170 - protein, 430 aa, Homo sapiens
  mature soluble human PH20, amino acid residues 36-465
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCI

SEQ ID NO: 171 - protein, 429 aa, Homo sapiens
  mature soluble human PH20, amino acid residues 36-464
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVC

SEQ ID NO: 172 - protein, 427 aa, Homo sapiens
  mature soluble human PH20, amino acid residues 36-462
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADG

SEQ ID NO: 173 - protein, 425 aa, Homo sapiens
  mature soluble human PH20, amino acid residues 36-460
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIA

SEQ ID NO: 174 - protein, 423 aa, Homo sapiens
  mature soluble human PH20, amino acid residues 36-458
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVC

SEQ ID NO: 175 - protein, 421 aa, Homo sapiens
  mature soluble human PH20, amino acid residues 36-456
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVD

SEQ ID NO: 176 - protein, 419 aa, Homo sapiens
  mature soluble human PH20, amino acid residues 36-454
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDA

SEQ ID NO: 177 - protein, 417 aa, Homo sapiens
  mature soluble human PH20, amino acid residues 36-452
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDT

SEQ ID NO: 178 - protein, 415 aa, Homo sapiens
  mature soluble human PH20, amino acid residues 36-450
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVK

SEQ ID NO: 179 - protein, 473 aa, Homo sapiens
  mature soluble human PH20, amino acid residues 36-508
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVAS

SEQ ID NO: 180 - protein, 471 aa, Homo sapiens
  mature soluble human PH20, amino acid residues 36-506
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSV

SEQ ID NO: 181 - protein, 469 aa, Homo sapiens
  mature soluble human PH20, amino acid residues 36-504
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIIS

SEQ ID NO: 182 - protein, 467 aa, Homo sapiens
  mature soluble human PH20, amino acid residues 36-502
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLI

SEQ ID NO: 183 - protein, 465 aa, Homo sapiens
  mature soluble human PH20, amino acid residues 36-500
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILF

SEQ ID NO: 184 - protein, 463 aa, Homo sapiens
  mature soluble human PH20, amino acid residues 36-498
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSI

SEQ ID NO: 185 - protein, 461 aa, Homo sapiens
  mature soluble human PH20, amino acid residues 36-496
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIV

SEQ ID NO: 186 - protein, 459 aa, Homo sapiens
  mature soluble human PH20, amino acid residues 36-494
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMF

SEQ ID NO: 187 - protein, 457 aa, Homo sapiens
  mature soluble human PH20, amino acid residues 36-492
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSAT

SEQ ID NO: 188 - protein, 453 aa, Homo sapiens
  mature soluble human PH20, amino acid residues 36-488
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPST

SEQ ID NO: 189 - protein, 451 aa, Homo sapiens
  mature soluble human PH20, amino acid residues 36-486
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASP

SEQ ID NO: 190 - DNA, 2105 bp, Bos taurus
  cow PH20 DNA
ggtttatctctgttcttggtgaggagacagacagaattgactgctgtgctcatccgcgagggtaaatgtgctcagctctttatggagtagtggagacgggcagagatgacaagatgaagcaacttgcaaaacattcctaaatacgaaggaagaagaatatttaaatgtaaatcatcattattcatttttatccatcaaagtggcttcattctgtgttcatatcttgcatcaaatattaggtacaccaaagcgtgtaggagaaaaaagtgcctttcacagtcatcgctctttgtgatgagaatgctgaggcgccaccatatctcctttcggagctttgctgggtctagcggaacaccccaggcagtgttcaccttccttctgcttccgtgttgtttggctctggacttcagagcaccccctcttatttcaaacacttctttcctctgggcctggaatgccccagttgaacgttgtgttaacagaagatttcaactacctccagatctgagactcttctctgtaaaaggaagcccccagaaaagtgctaccggacaatttattacattattttatgctgatagacttggctactatcctcatatagatgaaaaaacaggcaaaaccgtattcggaggaattccccagttgggaaacttaaaaagtcatatggagaaagcaaaaaatgacattgcctattacataccaaatgacagcgtgggcttggcggtcattgactgggaaaactggaggcctacctgggcaagaaactggaaacctaaagatgtttacagggatgagtcagttgagttggttctgcaaaaaaatccgcaactcagtttcccagaggcttccaagattgcaaaagtggattttgagacagcaggaaagagtttcatgcaagagactttaaaactgggaaaattacttcggccaaatcacttatggggttattatctttttcctgattgttacaatcataatcataaccaacctacttacaatggaaattgccctgatgtagaaaaaaggagaaatgatgatctcgagtggttgtggaaggaaagcactgcccttttcccttctgtttatttgaatatcaggttaaaatctactcaaaatgctgccttgtatgttcgtaatcgtgtccaggaagccattcggttgtctaaaatagcgagtgtcgaaagtccacttccggtttttgtatatgcccgtccagtttttactgatgggtcttcaacatatctttctcagggtgaccttgtgaattcggttggtgagatcgtttctctaggtgcctctgggattataatgtggggcagtctcaatctaagcttatctatgcaatcttgcatgaacctaggcacttacttgaacactacactgaatccttacataatcaacgtcaccctagccgccaaaatgtgcagccaagtgctttgccacaatgaaggagtgtgtacaaggaaacactggaattcaagcgactatcttcacctgaacccaatgaattttgctattcaaactggggaaggtggaaaatacacagtacctgggacagtcacacttgaagacttgcaaaagttttctgatacattttattgcagttgttatgccaacatccactgtaagaagagagttgatataaaaaatgttcatagtgttaacgtgtgtatggcagaagacatttgtatagacagccctgtgaagttacaacccagtgatcattcctccagccaggaggcatctactaccaccttcagcagtatctcaccctccactacaactgccacagtatctccatgtactcctgagaaacactcccctgagtgcctcaaagtcaggtgttcggaagtcatccccaacgtcacccaaaaggcgtgtcaaagtgttaaattgaagaacatttcctatcagtcacctattcaaaatattaaaaatcaaacaacctattaaaattaaattcagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaa

SEQ ID NO: 191 - DNA, 1971 bp, Bos taurus
  cow Hyal1 DNA
ttggtgcgcctggtgccagacttaaggaacagaatcttgctgatgcctgcacaggccctcgccctggggtcaggaagtttggagaatgaggcctttcagccttgaggtttccctacacctgccctgggctatggcagcccacttgcttcctgtctgcaccctgttcctgaacttgctcagcatgacccaaggctcccgggaccctgtggtccccaaccagcccttcactaccatctggaatgccaacaccgagtggtgtatgaagaaacacggcgtggacgtagacatcagtatctttgatgtggtgaccaacccggggcagaccttccgcggccctaacatgaccattttctacagctcccagctgggtacctacccttactatacatctgctggggagcctgtgtttggtggcctgccccagaatgccagcctgaatgcccacctggcccgcacattccaggacatcctggctgccatgcctgagcctcgcttctcagggctggcagtcattgactgggaggcatggcgcccgcgctgggccttcaactgggacaccaaggacatttaccggcagcgctcacgggcattggtacagaagcagcacccagactggctagctcctcgggtggaggccgcagctcaggaccagttcgagggggctgcagaggagtggatggcaggcaccctcaagctgggacaagcactgcgccctcagggcctctggggcttctataatttccctgagtgctacaactatgactttaaaagtcccaactatacaggccggtgtccactaaacatctgtgcccagaatgaccagctcgggtggctgtggggccagagccgtgccctctaccccagcatctacctgcctgcagcactggagggcacgaagaagacacagatgttcgtgcagcaccgtgtggctgaggcattccgtgtggcagcgggtgcgggggaccccaagctgccggtgctgccctacatgcagctcttctacgacatgactaaccactttctgcccgcggaggagctggagcacagcctgggggagagtgcagcccagggtgcagcgggagtggtgctctgggtgagctggctgagcacaagcaccaaggaatcatgccaggccatcaaggagtatgtggacacgacgctgggaccctccatcctgaatgtgaccagcggggctcgtctgtgcagtcaggtcctatgctccggccatggccgttgtgcccggcgccccagttaccccaaggcccgcctcatcctcaactccaccagtttttccatcaagcctacacctggtggtgggcccctgaccctacaaggtgccctctcgctcgaggatcggttgcggatggcagtggagttcgaatgtcgctgctaccgtgggtggagggggacacggtgtgagcagtggggcatgtggtgattggcatgggcacgcactgagtacctgatgcaagctgggcctggctaggtagggctttcccaagtccaggcagtcacaggagtcatggttacagtcagaagtccactcagccagtgtcatgagcatacaccagtgtgcacacctgcttacagaccaagatagctgcataaggacacggtgtgagcagtggggcatatgctgattggcatgggcacacactgagtacctgatgcaatctgggcctggctagggctttcccaagtccaggcagtcacaggagtcatggttaggcatccagtcacaggagtcatgtcaggcatcctgccgacagagtcaaaaatacttcctctggagacactgagtcagtcttcaaacagaagcagtcacaagcactgacattcgggacttccctggccatccagtggttaagacacggagcttccactgcagggggcacgggcagagactaagatcacgaatgctaagcggtgcggttaaacaaataacaaataaataaactgacattcactggg

SEQ ID NO: 192 - DNA, 1912 bp, Bos taurus
  cow Hyal2 DNA
caagtcgccggcgggctgcccaaagggcaggagctggcgcgaatagcttggctagagacttaccccgggaaggagggaggccgccgacctactgggccgacggactcccacacagttcctgagctggtgcctggcaggtgacactgacttcctgcagcccccagcatgtggacaggcctgggccccgccgtcacactggccctggtgttggtggtggcatgggccacggagctgaagcccacagcaccacccatcttcacgggccggccctttgtggtcgcatgggatgtgcccacacaggactgtggcccgcgccacaagatgccattggacccaaaggacatgaaggcctttgatgttcaggcttcacctaacgagggttttgtaaatcagaacatcaccatcttctaccgtgaccggctgggcatgtatccacacttcaattcggtggggaggtcagtacatggtggtgtgccacagaatggcagcctctgggtacacctggagatgctgaagggacacgtggaacactacattcgtacacaggagcctgcagggctggcagtcatcgactgggaggactggcggccagtgtgggtgcgcaactggcaggacaaggatgtgtaccgccgattatcacgccatttggtagccattcgccaccctgattggccaccagagcgcgtagccaaggaggcgcagtatgagtttgagttcgctgcacggcagttcatgctggagacattgcgatttgtcaaggcgtttcggcctcggcacctatggggcttctacctcttccctgactgttacaaccatgattatgtgcagaactgggagacctatacaggccgctgccctgatgttgaggtctcccgaaatgaccagctggcctggctctgggccgagagcacggccctcttcccctctgtctacttggaagagacactggcttcctccactcacggccgcaactttgtcagctttcgtgtccaggaggctcttcgcgtggctgacgtccaccatgccaaccatgcactccccgtctacgtcttcacgaggcccacctatagccgtggactcacagggcttagcgagatggatctcatctccaccattggtgagagtgctgccctgggtgcagctggcgtcatcctctggggtgacgcagggtttaccaccagcaacgagacctgccgacgcctcaaggattatctgactcggtcattggtaccctatgtcgtcaatgtgtcctgggctgcccagtactgcagctgggcccagtgccatggccatgggcgctgtgtgcgccgggaccccaacgctcacaccttcctgcacctcagtgccagcagcttccgtctagtgcctagccacgcacctgatgagccgcggctgcgaccagagggggaactcagttgggccgaccgcaaccacctacagatgcactttcgctgccagtgctacttaggctggggcggtgagcaatgccagtgggaccgcaggcgggcagctgggggtgccagtggggcctgggctgggtcccacctcactggcctgctggcagtggcagtcctggccttcacctagactttgtaagggtctctcacccagctgccacgccagctggcctctgccacaaggggtctgtcaggcatgtaggagcctgcaaggggtggacaaaccagagtctggaggggcagagccctctgggatgcctggtaggatgtccttaccagctcccaccccctgttctaagggggaggggcagtcccctggaaggccccgtctctccctgccagagaggaagaggggcacagctgggccggggaggacctgaccctactcccctgcccctggatagtttattattattattttggggtctcttttgtaaattaaatataaaacaact

SEQ ID NO: 193 - DNA, 1537 bp, Ovis aries
  sheep Hyal2 DNA
gcaaatgacactgacttcctgcagcccccagcatgtggacaggcctgggccccgccgtcacactggccctggtgttggtggtggcatgggccacagagctgaagcccacagcaccacccatcttcacgggccggccctttgtggttgcatgggatgtgcccacacaggactgtggcccacgccacaagatgccattggacccaaaggacatgaaggcctttgatgtgcaggcctcacctaacgagggttttgtaaatcagaacatcaccatcttctaccgtgaccggctgggcatgtatccacacttcaactcggtggggaggtcagtccatggtggtgtgccacagaatggcagcctctgggtacacctggagatgctgaagggacacgtggaacactacattcgtacacaggagcctgcagggctggcagtcatcgactgggaggactggcggccagtgtgggtgcgcaactggcaggacaaggatgtgtaccgccgattatcacgccagttggtggccagtcaccaccccgattggccaccagagcgcatagtcaaggaggcgcagtatgagtttgagttcgctgcacggcagttcatgctggagacactgcgatttgtcaaggcgtttcggcctcggcacctatggggcttctacctcttccctgactgttacaaccatgattatgtgcaaaactgggagacctatacaggccgctgccctgatgttgaggtctcccgaaatgaccagctgtcctggctctgggccgagagcacagccctcttcccctctgtctacctggaagagacgctggcttcctccactcacggccgcaactttgtcagctttcgtgtccaggaggctcttcgcgtggctgacgtccaccatgccaaccatgcactcccagtctacgtcttcacgaggcccacctacagccgtggactcacagggcttagcgagatggatctcatctccaccattggtgagagtgctgccctgggtgcagccggcgtcatcctctggggtgacgcagggtttaccaccagcaacgagacctgccgacgcctcaaggattatctgactcggtcactggtaccctatgtcgtcaatgtgtcctgggctgcccagtactgcagctgggcccagtgccatggccatgggcgctgtgtgcgccgggaccccaacgctcacaccttcctgcacctcagtgccagcagcttccgtctagtgcctagccacgcacctgatgagccgcggctgcgaccagagggggagctcagttgggccgaccgcaaccacctacagacgcactttcgctgccagtgctacttaggctggggcggtgagcagtgccagtgggaccgcaggcgggcagctgggggtgccagtggggcctgggctgggtcccacctcactggcctgctggcagtggcagtcctggccttcacctggacttcgtaagggtctcacccagctgccaggccagctggcctctgccacaaggggtctgccaggcatgtagcagcccacaaggg

SEQ ID NO: 194 - DNA, 1967 bp, Ovis aries
  sheep hyaluronidase DNA
actcctgtttatctctgttcttggtgaggagacagacagaattgactgctgtgctcatccaccaggttacagatgaagcaacttgcaaaacattcctaaatacgaaggaagaagagtatttaaacgtaaatcatcattattcatttttatccatcaaagtagcttcattctgtgttcctatcttgcatcaaatattaggtaaaccaaagtgtgtaggagaaaaaagtgcttttcatagtcatcgctctttgtgaagagaatgctaaggcgccgccatatctcctttaggagctttgttggggccagtggaacaccccaggcggcgctcgccttccttctgcttccatgttggttggctctggacttcagagcaccccctcttatttcaaacacttctttcctctgggcctggaatgccccagctgaacgttgtgttaaaatctttaaactacctccagatctgagactcttctctgtaaaaggaagcccccaaaaaagtgctacgggacaatttattacattattttatgctgatagacttggctactatcctcatatagatgaaaaaacaggcaacaccgtatatggaggaattccccagttgggaaacttaaaaaatcatttggaaaaagccaaaaaagacattgcctattatataccaaatgacagcgtgggcttggcggtcattgactgggaaaactggaggcctacctgggcaagaaactggaaacctaaagatgtttacagggatgagtctgttgagttggttctgcaaaaaaatccacaactcagtttcccagaggcttccaagattgcaaaagtggattttgagacagcaggaaagagtttcatgcaagagactttaaaactgggaaaattacttcggccaaatcacttatggggttattatctttttcctgattgttacaatcataattataaccagcctacttacaatggaaattgctctgatttagaaaaaaggagaaatgatgatctcgactggttgtggaaggaaagcactgcccttttcccttctgtttatttgaatatcaagttaaaatctactccaaaagctgccttctatgttcgtaatcgtgtccaggaagccattcggttgtctaaaatagcgagtgttgaaagtccacttccggtttttgtatatcaccgtccagtttttactgatgggtcttcaacatacctttctcagggtgaccttgtgaattcggttggtgagatcgttgctctaggtgcctctgggattataatgtggggcagtctcaatctaagcctaactatgcaatcttgcatgaacctaggcaattacttgaacactacactgaatccttacataatcaacgtcaccctagcagccaaaatgtgcagccaagtgctttgccacgatgaaggagtgtgtacaaggaaacaatggaattcaagcgactatcttcacctgaacccaatgaattttgctattcaaactgggaaaggtggaaaatacacagtacctgggaaagtcacacttgaagacctgcaaacgttttctgataaattttattgcagttgttatgccaacatcaactgtaagaagagagttgatataaaaaatgttcatagtgttaatgtatgtatggcagaagacatttgtatagagggccctgtgaagttacaacccagtgatcattcctctagccagaatgaggcatctactaccaccgtcagcagtatctcaccctctactacagccaccacagtatctccatgtactcctgagaaacagtcccctgagtgcctcaaagtcaggtgtttggaagccatcgccaacgtcacccaaacggggtgtcaaggtgttaaatggaagaacacttccagtcagtcaagtattcaaaatattaaaaatcaaacaacctattaaaatataaattcagtgcttattaagaaaaaaaaaaaaaaaaaaaaaaaaaaaa

SEQ ID NO: 195 - protein, 552 aa, Homo sapiens
  human hyaluronan synthase 2 gi4885391
MHCERFLCILRIIGTTLFGVSLLLGITAAYIVGYQFIQTDNYYFSFGLYGAFLASHLIIQSLFAFLEHRKMKKSLETPIKLNKTVALCIAAYQEDPDYLRKCLQSVKRLTYPGIKVVMVIDGNSEDDLYMMDIFSEVMGRDKSATYIWKNNFHEKGPGETDESHKESSQHVTQLVLSNKSICIMQKWGGKREVMYTAFRALGRSVDYVQVCDSDTMLDPASSVEMVKVLEEDPMVGGVGGDVQILNKYDSWISFLSSVRYWMAFNIERACQSYFGCVQCISGPLGMYRNSLLHEFVEDWYNQEFMGNQCSFGDDRHLTNRVLSLGYATKYTARSKCLTETPIEYLRWLNQQTRWSKSYFREWLYNAMWFHKHHLWMTYEAIITGFFPFFLIATVIQLFYRGKIWNILLFLLTVQLVGLIKSSFASCLRGNIVMVFMSLYSVLYMSSLLPAKMFAIATINKAGWGTSGRKTIVVNFIGLIPVSVWFTILLGGVIFTIYKESKRPFSESKQTVLIVGTLLYACYWVMLLTLYVVLINKCGRRKKGQQYDMVLDV

SEQ ID NO: 196 - DNA, 1849 bp, Artificial Sequence
  N-terminal His6-tagged hHAS2 cDNA
gtgcgaacgggcgtcttgtctgctgcagccaagcttgggctgcaggtcgacggatccgttaaccctagccaccatgcatcaccatcaccatcacggcggaggcggatcagggcattgtgagaggtttctatgtatcctgagaataattggaaccacactctttggagtctctctcctccttggaatcacagctgcttatattgttggctaccagtttatccaaacggataattactatttctcttttggactgtatggtgcctttttggcatcacacctcatcatccaaagcctgtttgcctttttggagcaccgaaaaatgaaaaaatccctagaaacccccataaagttgaacaaaacagttgccctttgcatcgctgcctatcaagaagatccagactacttaaggaaatgtttgcaatctgtgaaaaggctaacctaccctgggattaaagttgtcatggtcatagatgggaactcagaagatgacctttacatgatggacatcttcagtgaagtcatgggcagagacaaatcagccacttatatctggaagaacaacttccacgaaaagggtcccggtgagacagatgagtcacataaagaaagctcgcaacacgtaacgcaattggtcttgtccaacaaaagtatctgcatcatgcaaaaatggggtggaaaaagagaagtcatgtacacagccttcagagcactgggacgaagtgtggattatgtacaggtttgtgattcagacactatgcttgacccagcctcatctgtggagatggtaaaagttttagaagaagatcccatggttggaggtgttgggggagatgtccagattttaaacaagtacgattcctggatctcattcctcagcagtgtaagatattggatggcttttaatatagaaagggcctgtcagtcttattttgggtgtgttcagtgcattagtggacctctgggaatgtacagaaactccttgttgcatgagtttgtggaagattggtacaatcaagaatttatgggcaaccaatgtagctttggtgatgacaggcatctcacgaaccgggtgctgagcctgggctatgcaacaaaatacacagctcgatctaagtgccttactgaaacacctatagaatatctcagatggctaaaccagcagacccgttggagcaagtcctacttccgagaatggctgtacaatgcaatgtggtttcacaaacatcacttgtggatgacctacgaagcgattatcactggattctttcctttctttctcattgccacagtaatccagctcttctaccggggtaaaatttggaacattctcctcttcttgttaactgtccagctagtaggtctcataaaatcatcttttgccagctgccttagaggaaatatcgtcatggtcttcatgtctctctactcagtgttatacatgtcgagtttacttcccgccaagatgtttgcaattgcaacaataaacaaagctgggtggggcacatcaggaaggaaaaccattgttgttaatttcataggactcattccagtatcagtttggtttacaatcctcctgggtggtgtgattttcaccatttataaggagtctaaaaggccattttcagaatccaaacagacagttctaattgttggaacgttgctctatgcatgctattgggtcatgcttttgacgctgtatgtagttctcatcaataagtgtggcaggcggaagaagggacaacaatatgacatggtgcttgatgtatgagcggcctcgagagatcccctcaggatatagtagtttcgcttttgcatagggagggggaaatgtagtctatgcaattttttt

SEQ ID NO: 197 - DNA, 6419 bp, Artificial Sequence
  pLXRN
ttttgaaagaccccacccgtaggtggcaagctagcttaagtaacgccactttgcaaggcatggaaaaatacataactgagaatagaaaagttcagatcaaggtcaggaacaaagaaacagctgaataccaaacaggatatctgtggtaagcggttcctgccccggctcagggccaagaacagatgagacagctgagtgatgggccaaacaggatatctgtggtaagcagttcctgccccggctcggggccaagaacagatggtccccagatgcggtccagccctcagcagtttctagtgaatcatcagatgtttccagggtgccccaaggacctgaaaatgaccctgtaccttatttgaactaaccaatcagttcgcttctcgcttctgttcgcgcgcttccgctctccgagctcaataaaagagcccacaacccctcactcggcgcgccagtcttccgatagactgcgtcgcccgggtacccgtattcccaataaagcctcttgctgtttgcatccgaatcgtggtctcgctgttccttgggagggtctcctctgagtgattgactacccacgacgggggtctttcatttgggggctcgtccgggatttggagacccctgcccagggaccaccgacccaccaccgggaggtaagctggccagcaacttatctgtgtctgtccgattgtctagtgtctatgtttgatgttatgcgcctgcgtctgtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagccaagcttgggctgcaggtcgacggatccgttaaccctaggctcgagagatcccctcaggatatagtagtttcgcttttgcatagggagggggaaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattccgcattgcagagatattgtatttaagtgcctagctcgatacagcaaacgccatttgaccattcaccacattggtgtgcacctccaagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaaccctggccctattattgggtggactaaccatggggggaattgccgctggaataggaacagggactactgctctaatggccactcagcaattccagcagctccaagccgcagtacaggatgatctcagggaggttgaaaaatcaatctctaacctagaaaagtctctcacttccctgtctgaagttgtcctacagaatcgaaggggcctagacttgttatttctaaaagaaggagggctgtgtgctgctctaaaagaagaatgttgcttctatgcggaccacacaggactagtgagagacagcatggccaaattgagagagaggcttaatcagagacagaaactgtttgagtcaactcaaggatggtttgagggactgtttaacagatccccttggtttaccaccttgatatctaccattatgggacccctcattgtactcctaatgattttgctcttcggaccctgcattcttaatcgattagtccaatttgttaaagacaggatatcagtggtccaggctctagttttgactcaacaatatcaccagctgaagcctatagagtacgagccatagataaaataaaagattttatttagtctccagaaaaaggggggaatgaaagaccccacctgtaggtttggcaagctagcttaagtaacgccattttgcaaggcatggaaaaatacataactgagaatagagaagttcagatcaaggtcaggaacagatggaacagctgaatatgggccaaacaggatatctgtggtaagcagttcctgccccggctcagggccaagaacagatggaacagctgaatatgggccaaacaggatatctgtggtaagcagttcctgccccggctcagggccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggggcgccagtcctccgattgactgagtcgcccgggtacccgtgtatccaataaaccctcttgcagttgcatccgacttgtggtctcgctgttccttgggagggtctcctctgagtgattgactacccgtcagcgggggtctttcatttgggggctcgtccgggatcgggagacccctgcccagggaccaccgacccaccaccgggaggtaagctggctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaaagaattgctagcaattgctagcaattgctagcaattcataccagatcaccgaaaactgtcctccaaatgtgtccccctcacactcccaaattcgcgggcttctgcctcttagaccactctaccctattccccacactcaccggagccaaagccgcggcccttccgtttctttgc

SEQ ID NO: 198 - DNA, 6507 bp, Artificial Sequence
  pVSV-G envelope vector
gcggccgctctagagagcttggcccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccggtcgaccgatcctgagaacttcagggtgagtttggggacccttgattgttctttctttttcgctattgtaaaattcatgttatatggagggggcaaagttttcagggtgttgtttagaatgggaagatgtcccttgtatcaccatggaccctcatgataattttgtttctttcactttctactctgttgacaaccattgtctcctcttattttcttttcattttctgtaactttttcgttaaactttagcttgcatttgtaacgaatttttaaattcacttttgtttatttgtcagattgtaagtactttctctaatcacttttttttcaaggcaatcagggtatattatattgtacttcagcacagttttagagaacaattgttataattaaatgataaggtagaatatttctgcatataaattctggctggcgtggaaatattcttattggtagaaacaactacaccctggtcatcatcctgcctttctctttatggttacaatgatatacactgtttgagatgaggataaaatactctgagtccaaaccgggcccctctgctaaccatgttcatgccttcttctctttcctacagctcctgggcaacgtgctggttgttgtgctgtctcatcattttggcaaagaattcctcgacggatccctcgaggaattctgacactatgaagtgccttttgtacttagcctttttattcattggggtgaattgcaagttcaccatagtttttccacacaaccaaaaaggaaactggaaaaatgttccttctaattaccattattgcccgtcaagctcagatttaaattggcataatgacttaataggcacagccttacaagtcaaaatgcccaagagtcacaaggctattcaagcagacggttggatgtgtcatgcttccaaatgggtcactacttgtgatttccgctggtatggaccgaagtatataacacattccatccgatccttcactccatctgtagaacaatgcaaggaaagcattgaacaaacgaaacaaggaacttggctgaatccaggcttccctcctcaaagttgtggatatgcaactgtgacggatgccgaagcagtgattgtccaggtgactcctcaccatgtgctggttgatgaatacacaggagaatgggttgattcacagttcatcaacggaaaatgcagcaattacatatgccccactgtccataactctacaacctggcattctgactataaggtcaaagggctatgtgattctaacctcatttccatggacatcaccttcttctcagaggacggagagctatcatccctgggaaaggagggcacagggttcagaagtaactactttgcttatgaaactggaggcaaggcctgcaaaatgcaatactgcaagcattggggagtcagactcccatcaggtgtctggttcgagatggctgataaggatctctttgctgcagccagattccctgaatgcccagaagggtcaagtatctctgctccatctcagacctcagtggatgtaagtctaattcaggacgttgagaggatcttggattattccctctgccaagaaacctggagcaaaatcagagcgggtcttccaatctctccagtggatctcagctatcttgctcctaaaaacccaggaaccggtcctgctttcaccataatcaatggtaccctaaaatactttgagaccagatacatcagagtcgatattgctgctccaatcctctcaagaatggtcggaatgatcagtggaactaccacagaaagggaactgtgggatgactgggcaccatatgaagacgtggaaattggacccaatggagttctgaggaccagttcaggatataagtttcctttatacatgattggacatggtatgttggactccgatcttcatcttagctcaaaggctcaggtgttcgaacatcctcacattcaagacgctgcttcgcaacttcctgatgatgagagtttattttttggtgatactgggctatccaaaaatccaatcgagcttgtagaaggttggttcagtagttggaaaagctctattgcctcttttttctttatcatagggttaatcattggactattcttggttctccgagttggtatccatctttgcattaaattaaagcacaccaagaaaagacagatttatacagacatagagatgaaccgacttggaaagtaactcaaatcctgcacaacagattcttcatgtttggaccaaatcaacttgtgataccatgctcaaagaggcctcaattatatttgagtttttaatttttatgaaaaaaaaaaaaaaaaacggaattcctcgagggatccgtcgaggaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacggatcggccgcaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagctccaccgcggtg

SEQ ID NO: 199 - DNA, 23 bp, Artificial Sequence
  pLXSN 5' primer (1398-1420)
cccttgaacctcctcgttcgacc

SEQ ID NO: 200 - DNA, 23 bp, Artificial Sequence
  pLXSN 3' primer (1537-1515)
gagcctggggactttccacaccc

SEQ ID NO: 201 - DNA, 8092 bp, Artificial Sequence
  pLXRN-hHAS2
ttttgaaagaccccacccgtaggtggcaagctagcttaagtaacgccactttgcaaggcatggaaaaatacataactgagaatagaaaagttcagatcaaggtcaggaacaaagaaacagctgaataccaaacaggatatctgtggtaagcggttcctgccccggctcagggccaagaacagatgagacagctgagtgatgggccaaacaggatatctgtggtaagcagttcctgccccggctcggggccaagaacagatggtccccagatgcggtccagccctcagcagtttctagtgaatcatcagatgtttccagggtgccccaaggacctgaaaatgaccctgtaccttatttgaactaaccaatcagttcgcttctcgcttctgttcgcgcgcttccgctctccgagctcaataaaagagcccacaacccctcactcggcgcgccagtcttccgatagactgcgtcgcccgggtacccgtattcccaataaagcctcttgctgtttgcatccgaatcgtggtctcgctgttccttgggagggtctcctctgagtgattgactacccacgacgggggtctttcatttgggggctcgtccgggatttggagacccctgcccagggaccaccgacccaccaccgggaggtaagctggccagcaacttatctgtgtctgtccgattgtctagtgtctatgtttgatgttatgcgcctgcgtctgtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagccaagcttgggctgcaggtcgacggatccgttaaccctagccaccatgcatcaccatcaccatcacggcggaggcggatcagggcattgtgagaggtttctatgtatcctgagaataattggaaccacactctttggagtctctctcctccttggaatcacagctgcttatattgttggctaccagtttatccaaacggataattactatttctcttttggactgtatggtgcctttttggcatcacacctcatcatccaaagcctgtttgcctttttggagcaccgaaaaatgaaaaaatccctagaaacccccataaagttgaacaaaacagttgccctttgcatcgctgcctatcaagaagatccagactacttaaggaaatgtttgcaatctgtgaaaaggctaacctaccctgggattaaagttgtcatggtcatagatgggaactcagaagatgacctttacatgatggacatcttcagtgaagtcatgggcagagacaaatcagccacttatatctggaagaacaacttccacgaaaagggtcccggtgagacagatgagtcacataaagaaagctcgcaacacgtaacgcaattggtcttgtccaacaaaagtatctgcatcatgcaaaaatggggtggaaaaagagaagtcatgtacacagccttcagagcactgggacgaagtgtggattatgtacaggtttgtgattcagacactatgcttgacccagcctcatctgtggagatggtaaaagttttagaagaagatcccatggttggaggtgttgggggagatgtccagattttaaacaagtacgattcctggatctcattcctcagcagtgtaagatattggatggcttttaatatagaaagggcctgtcagtcttattttgggtgtgttcagtgcattagtggacctctgggaatgtacagaaactccttgttgcatgagtttgtggaagattggtacaatcaagaatttatgggcaaccaatgtagctttggtgatgacaggcatctcacgaaccgggtgctgagcctgggctatgcaacaaaatacacagctcgatctaagtgccttactgaaacacctatagaatatctcagatggctaaaccagcagacccgttggagcaagtcctacttccgagaatggctgtacaatgcaatgtggtttcacaaacatcacttgtggatgacctacgaagcgattatcactggattctttcctttctttctcattgccacagtaatccagctcttctaccggggtaaaatttggaacattctcctcttcttgttaactgtccagctagtaggtctcataaaatcatcttttgccagctgccttagaggaaatatcgtcatggtcttcatgtctctctactcagtgttatacatgtcgagtttacttcccgccaagatgtttgcaattgcaacaataaacaaagctgggtggggcacatcaggaaggaaaaccattgttgttaatttcataggactcattccagtatcagtttggtttacaatcctcctgggtggtgtgattttcaccatttataaggagtctaaaaggccattttcagaatccaaacagacagttctaattgttggaacgttgctctatgcatgctattgggtcatgcttttgacgctgtatgtagttctcatcaataagtgtggcaggcggaagaagggacaacaatatgacatggtgcttgatgtatgagcggcctcgagagatcccctcaggatatagtagtttcgcttttgcatagggagggggaaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattccgcattgcagagatattgtatttaagtgcctagctcgatacagcaaacgccatttgaccattcaccacattggtgtgcacctccaagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaaccctggccctattattgggtggactaaccatggggggaattgccgctggaataggaacagggactactgctctaatggccactcagcaattccagcagctccaagccgcagtacaggatgatctcagggaggttgaaaaatcaatctctaacctagaaaagtctctcacttccctgtctgaagttgtcctacagaatcgaaggggcctagacttgttatttctaaaagaaggagggctgtgtgctgctctaaaagaagaatgttgcttctatgcggaccacacaggactagtgagagacagcatggccaaattgagagagaggcttaatcagagacagaaactgtttgagtcaactcaaggatggtttgagggactgtttaacagatccccttggtttaccaccttgatatctaccattatgggacccctcattgtactcctaatgattttgctcttcggaccctgcattcttaatcgattagtccaatttgttaaagacaggatatcagtggtccaggctctagttttgactcaacaatatcaccagctgaagcctatagagtacgagccatagataaaataaaagattttatttagtctccagaaaaaggggggaatgaaagaccccacctgtaggtttggcaagctagcttaagtaacgccattttgcaaggcatggaaaaatacataactgagaatagagaagttcagatcaaggtcaggaacagatggaacagctgaatatgggccaaacaggatatctgtggtaagcagttcctgccccggctcagggccaagaacagatggaacagctgaatatgggccaaacaggatatctgtggtaagcagttcctgccccggctcagggccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggggcgccagtcctccgattgactgagtcgcccgggtacccgtgtatccaataaaccctcttgcagttgcatccgacttgtggtctcgctgttccttgggagggtctcctctgagtgattgactacccgtcagcgggggtctttcatttgggggctcgtccgggatcgggagacccctgcccagggaccaccgacccaccaccgggaggtaagctggctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattcataccagatcaccgaaaactgtcctccaaatgtgtccccctcacactcccaaattcgcgggcttctgcctcttagaccactctaccctattccccacactcaccggagccaaagccgcggcccttccgtttctttgc

SEQ ID NO: 202 - protein, 657 aa, Homo sapiens
  recombinant human aggrecan G1-IGD-G2 domains, Val20-Gly676 of Accession No. NP_037359
VETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATLATTGQLYAAWSRGLDKCYAGWLADGSLRYPIVTPRPACGGDKPGVRTVYLYPNQTGLPDPLSRHHAFCFRG

SEQ ID NO: 203 - DNA, 669 bp, Homo sapiens
  cDNA fragment of human IgG1 heavy chain
acatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggccccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 204 - protein, 223 aa, Homo sapiens
  fragment of IgG1 heavy chain
TCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGPFFLYSKLTVDKSRWQQGNVFSCSVMHEALHNHYTQKSLSLSPGK

SEQ ID NO: 205 - DNA, 1439 bp, Homo sapiens
  human Tumor necrosis factor-stimulated gene-6 (TSG-6) preprotein-encoding DNA GI No. 315139000
agtcacatttcagccactgctctgagaatttgtgagcagcccctaacaggctgttacttcactacaactgacgatatgatcatcttaatttacttatttctcttgctatgggaagacactcaaggatggggattcaaggatggaatttttcataactccatatggcttgaacgagcagccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacccacacgcaaaggagtgtggtggcgtctttacagatccaaagcaaatttttaaatctccaggcttcccaaatgagtacgaagataaccaaatctgctactggcacattagactcaagtatggtcagcgtattcacctgagttttttagattttgaccttgaagatgacccaggttgcttggctgattatgttgaaatatatgacagttacgatgatgtccatggctttgtgggaagatactgtggagatgagcttccagatgacatcatcagtacaggaaatgtcatgaccttgaagtttctaagtgatgcttcagtgacagctggaggtttccaaatcaaatatgttgcaatggatcctgtatccaaatccagtcaaggaaaaaatacaagtactacttctactggaaataaaaactttttagctggaagatttagccacttataaaaaaaaaaaaaaggatgatcaaaacacacagtgtttatgttggaatcttttggaactcctttgatctcactgttattattaacatttatttattatttttctaaatgtgaaagcaatacataatttagggaaaattggaaaatataggaaactttaaacgagaaaatgaaacctctcataatcccactgcatagaaataacaagcgttaacattttcatatttttttctttcagtcatttttctatttgtggtatatgtatatatgtacctatatgtatttgcatttgaaattttggaatcctgctctatgtacagttttgtattatactttttaaatcttgaactttataaacattttctgaaatcattgattattctacaaaaacatgattttaaacagctgtaaaatattctatgatatgaatgttttatgcattatttaagcctgtctctattgttggaatttcaggtcattttcataaatattgttgcaataaatatccttgaacacacaaaaaaaaaaaaaaaa

SEQ ID NO: 206 - protein, 277 aa, Homo sapiens
  human Tumor necrosis factor-stimulated gene-6 (TSG-6) preprotein, P98066
  SIGNAL (1)...(17): signal sequence
MIILIYLFLLLWEDTQGWGFKDGIFHNSIWLERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKECGGVFTDPKQIFKSPGFPNEYEDNQICYWHIRLKYGQRIHLSFLDFDLEDDPGCLADYVEIYDSYDDVHGFVGRYCGDELPDDIISTGNVMTLKFLSDASVTAGGFQIKYVAMDPVSKSSQGKNTSTTSTGNKNFLAGRFSHL

SEQ ID NO: 207 - protein, 95 aa, Homo sapiens
  human TSG-6 aa residues 35-129
AGVYHREARSGKYKLTYAEAKAVCEFEGGHLATYKQLEAARKIGFHVCAAGWMAKGRVGYPIVKPGPNCGFGKTGIIDYGIRLNRSERWDAYCYN

SEQ ID NO: 208 - DNA, 12 bp, Artificial Sequence
  12 bp sequence
gacaaaactcac

SEQ ID NO: 209 - protein, 4 aa, Artificial Sequence
  4 amino acid peptide
DKTH

SEQ ID NO: 210 - protein, 22 aa, Homo sapiens
  IgK signal peptide
MDMRVPAQLLGLLLLWLPGARG

SEQ ID NO: 211 - DNA, 1059 bp, Artificial Sequence
  TSG-6-LM-Fc fusion protein - Codon optimized DNA Seq. used for protein expression
gctagcatggacatgcgtgtgccagctcagctgctgggactgctgctgctgtggctgcctggagctagaggagcagatatcgcaggcgtgtaccacagggaggcacggtccggaaagtacaaactgacctatgctgaagcaaaggccgtgtgcgagttcgaaggcggacacctggctacatataagcagctggaggccgctcgcaaaatcgggtttcacgtgtgcgcagccggttggatggcaaaggggcgagtcggttaccccattgtgaaaccaggccccaactgtggcttcggaaagactggcatcattgactatggaatcagactgaaccgcagcgagcgatgggacgcatactgctataataccggtgataagactcacacctgccccccttgtcctgccccagaactgctggggggtccttccgtgttcctgtttccacccaagccaaaagacaccctgatgatttctaggacacctgaggtcacttgcgtggtcgtggacgtgagtcacgaagatccagaagtcaagtttaactggtacgtggatggcgtcgaagtgcataatgccaagacaaaacctcgtgaggaacagtacaattctacttatagggtcgtgagtgtcctgaccgtgctgcatcaggattggctgaacgggaaggagtataagtgcaaagtgtcaaataaggctctgcccgcacctatcgagaaaacaatttccaaggccaaaggccagccacgggaaccccaggtgtacactctgcctccatccagagaggaaatgaccaaaaaccaggtcagcctgacatgtctggtgaaggggttctatccaagcgacatcgctgtggagtgggaatctaatggtcagcccgagaacaattacaagaccacaccccctgtcctggactccgatggcagcttctttctgtattcaaagctgacagtggataaatcccgctggcagcagggaaacgtcttctcctgtagcgtgatgcatgaggctctgcacaatcattacactcagaagtctctgagtctgtcaccagggaaaggatcc

SEQ ID NO: 212 - protein, 349 aa, Artificial Sequence
  Peptide sequence for TSG-6-LM-Fc fusion protein
MRVPAQLLGLLLLWLPGARGADIAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNTGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGS

SEQ ID NO: 213 - DNA, 5540 bp, Artificial Sequence
  pHZ24-TSG-6-LM-Fc (DNA)
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcatggacatgcgtgtgccagctcagctgctgggactgctgctgctgtggctgcctggagctagaggagcagatatcgcaggcgtgtaccacagggaggcacggtccggaaagtacaaactgacctatgctgaagcaaaggccgtgtgcgagttcgaaggcggacacctggctacatataagcagctggaggccgctcgcaaaatcgggtttcacgtgtgcgcagccggttggatggcaaaggggcgagtcggttaccccattgtgaaaccaggccccaactgtggcttcggaaagactggcatcattgactatggaatcagactgaaccgcagcgagcgatgggacgcatactgctataataccggtgataagactcacacctgccccccttgtcctgccccagaactgctggggggtccttccgtgttcctgtttccacccaagccaaaagacaccctgatgatttctaggacacctgaggtcacttgcgtggtcgtggacgtgagtcacgaagatccagaagtcaagtttaactggtacgtggatggcgtcgaagtgcataatgccaagacaaaacctcgtgaggaacagtacaattctacttatagggtcgtgagtgtcctgaccgtgctgcatcaggattggctgaacgggaaggagtataagtgcaaagtgtcaaataaggctctgcccgcacctatcgagaaaacaatttccaaggccaaaggccagccacgggaaccccaggtgtacactctgcctccatccagagaggaaatgaccaaaaaccaggtcagcctgacatgtctggtgaaggggttctatccaagcgacatcgctgtggagtgggaatctaatggtcagcccgagaacaattacaagaccacaccccctgtcctggactccgatggcagcttctttctgtattcaaagctgacagtggataaatcccgctggcagcagggaaacgtcttctcctgtagcgtgatgcatgaggctctgcacaatcattacactcagaagtctctgagtctgtcaccagggaaaggatcctagtaagaattcctcgagagatctatagctaacgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacagcggccgctgccatcatggttcgaccattgaactgcatcgtcgccgtgtcccaaaatatggggattggcaagaacggagacctaccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaaacgcgtggtacctctagagtcgacctgggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataagtatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgag

SEQ ID NO: 214 - DNA, 1059 bp, Artificial Sequence
  TSG-6-LM-Fc/deltaHep (DNA)
gctagcatggacatgcgtgtgccagctcagctgctgggactgctgctgctgtggctgcctggagctagaggagcagatatcgcaggcgtgtaccacagggaggcacggtccggaaagtacaaactgacctatgctgaagcagcggccgtgtgcgagttcgaaggcggacacctggctacatatgcgcagctggaggccgctcgcgcaatcgggtttcacgtgtgcgcagccggttggatggcaaaggggcgagtcggttaccccattgtgaaaccaggccccaactgtggcttcggaaagactggcatcattgactatggaatcagactgaaccgcagcgagcgatgggacgcatactgctataataccggtgataagactcacacctgccccccttgtcctgccccagaactgctggggggtccttccgtgttcctgtttccacccaagccaaaagacaccctgatgatttctaggacacctgaggtcacttgcgtggtcgtggacgtgagtcacgaagatccagaagtcaagtttaactggtacgtggatggcgtcgaagtgcataatgccaagacaaaacctcgtgaggaacagtacaattctacttatagggtcgtgagtgtcctgaccgtgctgcatcaggattggctgaacgggaaggagtataagtgcaaagtgtcaaataaggctctgcccgcacctatcgagaaaacaatttccaaggccaaaggccagccacgggaaccccaggtgtacactctgcctccatccagagaggaaatgaccaaaaaccaggtcagcctgacatgtctggtgaaggggttctatccaagcgacatcgctgtggagtgggaatctaatggtcagcccgagaacaattacaagaccacaccccctgtcctggactccgatggcagcttctttctgtattcaaagctgacagtggataaatcccgctggcagcagggaaacgtcttctcctgtagcgtgatgcatgaggctctgcacaatcattacactcagaagtctctgagtctgtcaccagggaaaggatcc

SEQ ID NO: 215 - protein, 349 aa, Artificial Sequence
  TSG-6-LM-Fc/deltaHep (protein)
MRVPAQLLGLLLLWLPGARGADIAGVYHREARSGKYKLTYAEAAAVCEFEGGHLATYAQLEAARAIGFHVCAAGWMAKGRVGYPIVKPGPNCGFGKTGIIDYGIRLNRSERWDAYCYNTGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGS

SEQ ID NO: 216 - DNA, 285 bp, Homo sapiens
  TSG-6 preprotein, DNA encoding aa 35-129 (285 bp)
gccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaac

SEQ ID NO: 217 - DNA, 1059 bp, Artificial Sequence
  TSG-6-LM-Fc fusion protein encoding DNA
gctagcatggacatgcgcgtacctgctcagttgttggggctcttgctgctgtggttgcccggggcacgtggggcagatatcgccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacaccggtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaaggatcc

SEQ ID NO: 218 - DNA, 5540 bp, Artificial Sequence
  pHZ24-TSG-6-LM-Fc/deltaHep (DNA)
tcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcatggacatgcgtgtgccagctcagctgctgggactgctgctgctgtggctgcctggagctagaggagcagatatcgcaggcgtgtaccacagggaggcacggtccggaaagtacaaactgacctatgctgaagcagcggccgtgtgcgagttcgaaggcggacacctggctacatatgcgcagctggaggccgctcgcgcaatcgggtttcacgtgtgcgcagccggttggatggcaaaggggcgagtcggttaccccattgtgaaaccaggccccaactgtggcttcggaaagactggcatcattgactatggaatcagactgaaccgcagcgagcgatgggacgcatactgctataataccggtgataagactcacacctgccccccttgtcctgccccagaactgctggggggtccttccgtgttcctgtttccacccaagccaaaagacaccctgatgatttctaggacacctgaggtcacttgcgtggtcgtggacgtgagtcacgaagatccagaagtcaagtttaactggtacgtggatggcgtcgaagtgcataatgccaagacaaaacctcgtgaggaacagtacaattctacttatagggtcgtgagtgtcctgaccgtgctgcatcaggattggctgaacgggaaggagtataagtgcaaagtgtcaaataaggctctgcccgcacctatcgagaaaacaatttccaaggccaaaggccagccacgggaaccccaggtgtacactctgcctccatccagagaggaaatgaccaaaaaccaggtcagcctgacatgtctggtgaaggggttctatccaagcgacatcgctgtggagtgggaatctaatggtcagcccgagaacaattacaagaccacaccccctgtcctggactccgatggcagcttctttctgtattcaaagctgacagtggataaatcccgctggcagcagggaaacgtcttctcctgtagcgtgatgcatgaggctctgcacaatcattacactcagaagtctctgagtctgtcaccagggaaaggatcctagtaagaattcctcgagagatctatagctaacgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataagcttgccacaacccacagcggccgctgccatcatggttcgaccattgaactgcatcgtcgccgtgtcccaaaatatggggattggcaagaacggagacctaccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaaacgcgtggtacctctagagtcgacctgggcggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaaaatcgataagtatccgggctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgag

SEQ ID NO: 219 - DNA, 2116 bp, Homo sapiens
  HAS1 (DNA)
cggagagaagagagagcccggccagacccactgcgatgagacagcaggacgcgcccaagcccactcctgcagcctgccgctgctccggcctggcccggagggtgctgaccatcgccttcgccctgctcatcctgggcctcatgacctgggcctacgccgccggggtgccgctggcctccgatcgctacggcctcctggccttcggcctctacggggccttcctttcagcgcacctggtggcgcagagcctcttcgcgtacctggagcaccggcgggtggcggcggcggcgcgggggccgctggatgcagccaccgcgcgcagtgtggcgctgaccatctccgcctaccaggaggaccccgcgtacctgcgccagtgcctggcgtccgcccgcgccctgctgtacccgcgcgcgcggctgcgcgtcctcatggtggtggatggcaaccgcgccgaggacctctacatggtcgacatgttccgcgaggtcttcgctgacgaggaccccgccacgtacgtgtgggacggcaactaccaccagccctgggaacccgcggcggcgggcgcggtgggcgccggagcctatcgggaggtggaggcggaggatcctgggcggctggcagtggaggcgctggtgaggactcgcaggtgcgtgtgcgtggcgcagcgctggggcggcaagcgcgaggtcatgtacacagccttcaaggcgctcggagattcggtggactacgtgcaggtctgtgactcggacacaaggttggaccccatggcactgctggagctcgtgcgggtactggacgaggacccccgggtaggggctgttggtggggacgtgcggatccttaaccctctggactcctgggtcagcttcctaagcagcctgcgatactgggtagccttcaatgtggagcgggcttgtcagagctacttccactgtgtatcctgcatcagcggtcctctaggcctatataggaataacctcttgcagcagtttcttgaggcctggtacaaccagaagttcctgggtacccactgtacttttggggatgaccggcacctcaccaaccgcatgctcagcatgggttatgctaccaagtacacctccaggtcccgctgctactcagagacgccctcgtccttcctgcggtggctgagccagcagacacgctggtccaagtcgtacttccgtgagtggctgtacaacgcgctctggtggcaccggcaccatgcgtggatgacctacgaggcggtggtctccggcctgttccccttcttcgtggcggccactgtgctgcgtctgttctacgcgggccgcccttgggcgctgctgtgggtgctgctgtgcgtgcagggcgtggcactggccaaggcggccttcgcggcctggctgcggggctgcctgcgcatggtgcttctgtcgctctacgcgcccctctacatgtgtggcctcctgcctgccaagttcctggcgctagtcaccatgaaccagagtggctggggcacctcgggccggcggaagctggccgctaactacgtccctctgctgcccctggcgctctgggcgctgctgctgcttgggggcctggtccgcagcgtagcacacgaggccagggccgactggagcggcccttcccgcgcagccgaggcctaccacttggccgcgggggccggcgcctacgtgggctactgggtggccatgttgacgctgtactgggtgggcgtgcggaggctttgccggcggcggaccgggggctaccgcgtccaggtgtgagtccagccacgcggatgccgcctcaagggtcttcaggggaggccagaggagagctgctgggccccgagccacgaacttgctgggtggttctctgggcctcagtttccctcctctgcaaaacgagggggtcagcccaagattcttcagtctggactatattgggactgggacttctgggtctccagggagggtatttattggtcagggtgtgggatctgaggagtggagggaaagggtcctgctttctcctcgttcttatttaatctccatttctactgtgtgatcaggatgtaataaagaattttatttattttcaaaaaaaaaaaaaaaaaaaaaaaaaaaaa

SEQ ID NO: 220 - DNA, 3275 bp, Homo sapiens
  HAS2 (DNA)
gaagtcaagacgtctggaaagaattacccagtcctggcttcgagcagcccattgaaccagagacttgaaacagccccagccaaagacttttctcccaattctgcgcttcctgggttctgctgagtcttccacaggctttttttttttttttttttttttttaagacgaaaaagagattttctgttatcgggggcagaaagactgaagcccaaaaaaaaaaaaaaaaaaaaaagaaaagaaaagaaaaaagaaaagttaatttatttttaaagcataatttttttaagaattagactgaagtgcaacggaaacataaagagaatattagtgaaattattttttaaagtggggaagaatcaaacatttaagactcccctatcctttttaaatgttgtttttaaatttcttattttttttggccggtcgtctcaaattcatctgatctcttattacctcaattttggaaactgcccgccaccgaccctccgggaccacacagacaggctgaggacgactttatgaccaagagctgaacaagatgcattgtgagaggtttctatgtatcctgagaataattggaaccacactctttggagtctctctcctccttggaatcacagctgcttatattgttggctaccagtttatccaaacggataattactatttctcttttggactgtatggtgcctttttggcatcacacctcatcatccaaagcctgtttgcctttttggagcaccgaaaaatgaaaaaatccctagaaacccccataaagttgaacaaaacagttgccctttgcatcgctgcctatcaagaagatccagactacttaaggaaatgtttgcaatctgtgaaaaggctaacctaccctgggattaaagttgtcatggtcatagatgggaactcagaagatgacctttacatgatggacatcttcagtgaagtcatgggcagagacaaatcagccacttatatctggaagaacaacttccacgaaaagggtcccggtgagacagatgagtcacataaagaaagctcgcaacacgtaacgcaattggtcttgtccaacaaaagtatctgcatcatgcaaaaatggggtggaaaaagagaagtcatgtacacagccttcagagcactgggacgaagtgtggattatgtacaggtttgtgattcagacactatgcttgacccagcctcatctgtggagatggtaaaagttttagaagaagatcccatggttggaggtgttgggggagatgtccagattttaaacaagtacgattcctggatctcattcctcagcagtgtaagatattggatggcttttaatatagaaagggcctgtcagtcttattttgggtgtgttcagtgcattagtggacctctgggaatgtacagaaactccttgttgcatgagtttgtggaagattggtacaatcaagaatttatgggcaaccaatgtagctttggtgatgacaggcatctcacgaaccgggtgctgagcctgggctatgcaacaaaatacacagctcgatctaagtgccttactgaaacacctatagaatatctcagatggctaaaccagcagacccgttggagcaagtcctacttccgagaatggctgtacaatgcaatgtggtttcacaaacatcacttgtggatgacctacgaagcgattatcactggattctttcctttctttctcattgccacagtaatccagctcttctaccggggtaaaatttggaacattctcctcttcttgttaactgtccagctagtaggtctcataaaatcatcttttgccagctgccttagaggaaatatcgtcatggtcttcatgtctctctactcagtgttatacatgtcgagtttacttcccgccaagatgtttgcaattgcaacaataaacaaagctgggtggggcacatcaggaaggaaaaccattgttgttaatttcataggactcattccagtatcagtttggtttacaatcctcctgggtggtgtgattttcaccatttataaggagtctaaaaggccattttcagaatccaaacagacagttctaattgttggaacgttgctctatgcatgctattgggtcatgcttttgacgctgtatgtagttctcatcaataagtgtggcaggcggaagaagggacaacaatatgacatggtgcttgatgtatgatcttccatgttttgacgtttgcagtcacacacaacaccttagttcctctaggggctgtacagtattgtggcatcagataatgccaccaaaggagacatatcactgctgctgggacttgaacaaagacatttatatgggtttattttcattctgccaaagtaaaacaatacatcaacaagaagaaactcagatttaacctgttatttctatgaaaatgggatgaattctttgtttatgcactttttccttactgtgcatccgcctgaaagtgttttgccctatatacctcactagccatgctttatgtgggttatcatggaagaaaaggattttggaaactcaaggaaaagttctttcaacctatacaacctaacttatggactgttttgatagatgataattttttttttttaggaaggattttctttttaactttaccaaatgaaatgccaaaggaagttttaaaggccgttggctgtgctgtattttgatataattgtactgtgtttttaaattttgtatgccaatcttaaagacaaattttgcatattctctattttacttttctgccaaaataaacctgttcttccttttttaaaataaaataagttcttaaaaaatttatacttaaaaaatcctgcccaaaatgtgaagcttggttgactgatgttcatgatagaaagaataaaatgtttctctctctctaccttttaaaattgaatagtttatttctgtgaaagaagtatttaaactttcaatattttaactttttgtttttatttcttttagaaaaggccaatatacctatcacactttggaagtaaaaatacacactttcgtgtgtacctaaaaaaaaaatcgttgaaaatcaaggccaaaggtagtgcaattttttcattaagatttaaaaaaaagggaatgatagtctttgaaagaaaacagtaggcatccagcactggacaaaacatgggtatcaaagatgaataatctttggagattctggcagtgttttcccagaacaagtcaagtggaaagtggagaaattatctgtataattttggacacatacaatgcagtt

SEQ ID NO: 221 - DNA, 4220 bp, Homo sapiens
  HAS3 (DNA)
gagtgcgttcgcggctgctttgacctggtgggcgccgcctccggcactgcaccgaggcggggcgccagcgcccaggttgctgggctggccttggcgcccccttcccctacccagagcgcaggcaggcaggggggtcccgccgcgccccttcagcatatgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctttttgccttcctggagcaccggcgcatgcgacgtgccggccaggccctgaagctgccctccccgcggcggggctcggtggcactgtgcattgccgcataccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaagcgcgaggtcatgtacacggccttcaaggccctcggcgattcggtggactacatccaggtgtgcgactctgacactgtgctggatccagcctgcaccatcgagatgcttcgagtcctggaggaggatccccaagtagggggagtcgggggagatgtccagatcctcaacaagtacgactcatggatttccttcctgagcagcgtgcggtactggatggccttcaacgtggagcgggcctgccagtcctactttggctgtgtgcagtgtattagtgggcccttgggcatgtaccgcaacagcctcctccagcagttcctggaggactggtaccatcagaagttcctaggcagcaagtgcagcttcggggatgaccggcacctcaccaaccgagtcctgagccttggctaccgaactaagtataccgcgcgctccaagtgcctcacagagacccccactaagtacctccggtggctcaaccagcaaacccgctggagcaagtcttacttccgggagtggctctacaactctctgtggttccataagcaccacctctggatgacctacgagtcagtggtcacgggtttcttccccttcttcctcattgccacggttatacagcttttctaccggggccgcatctggaacattctcctcttcctgctgacggtgcagctggtgggcattatcaaggccacctacgcctgcttccttcggggcaatgcagagatgatcttcatgtccctctactccctcctctatatgtccagccttctgccggccaagatctttgccattgctaccatcaacaaatctggctggggcacctctggccgaaaaaccattgtggtgaacttcattggcctcattcctgtgtccatctgggtggcagttctcctgggagggctggcctacacagcttattgccaggacctgttcagtgagacagagctagccttccttgtctctggggctatactgtatggctgctactgggtggccctcctcatgctatatctggccatcatcgcccggcgatgtgggaagaagccggagcagtacagcttggcttttgctgaggtgtgacatggcccccaagcagagcgggtaaagtgcaatgggtaagggagggaaggggaatggaagagaaaagacagggtgggagggaggagggagtgctgtgttttagtctcttaatggtccaaaggacaaatctaaaatgcaaagaacggtgatgtagtatggcctgacagctctgtttagaggaggcaacactgatcccccagatgcagggctgcaggggattctgtgttttcagactgcctgtctgcttgcatctgcacataggcagtagcctcctcctgggctccagagggcactcagaagttgtgctaaaccaagttaagtcccattcagtggcaacttgtgataggtacctgagtgacggcaacctgcggaaggaggttctcccagcccatctgaacacaaccagaggtggcaggagaatttctactgagcgagctgggccggttagtgtatgtcacccccaccccacccctaagtagtcatcaatgcaataagattgcgcctgagatacaaggcccagaagcctgatctttgggcatcagaaaacagggtccaggaatggtgctttatgtgagataccccactccacatcaacattccagggatgagccaaaccagcagggagttagcactgaactgcttttaaaagtgcacattaaaaaggaaagtttgccaggaggaacaaagagattgtggtggtgctaaaggaggccataagctacacagaggccttgggtgttccacctggaaactgctcagacgtctagatgggttcttagcttgtctgtgatctctgctggggagataaaaagattaagccccaacatgttcagaaaagaagtgaagtcttgggtattttaacctgtatactcttgaattcctctcaaattcagctctgatctgaggctaagacacactccccacttcactttcttcaaagccacattttttgaggtatcactgcagtcacctcttctaccctcatcatcataggtaaggttttcaaggtggcaattggggcggagccccggctcttatagaagcttcagcaggaggcaagcgtgttctcagcacatatgggaactatgaggagcctctgatcaaattggctacaatcttggagctgcttggacggattccttggcagccgggttagcatgtgtgactttcaggctactgttcttgacaatcatctccaatggaaagcttttcagtgttcccaaagtgaactctcaaatccaaaatggttatctttgagaccatccattctcctcagtggcttctccagggaattcttacagccaagttgtgacagtcactgcatttgcctgcttctttccagaaaccaaactaggagatgaaactggttcctacatcctaaggttcttgctttctctctcatgcctcctgaggctgtttttggctgttttccctctgctgcttttggggaatgaggggaagccattttccagtgacttgcaatccaggctgttctcagcgttttgagtttaaaacctgggatcctgactaagcctttgacttaagggttgcttgcttgccctccaaatgtcctttctcagaggggccagctaacccgtgcagaaccagcactaaggtggacagcagacaagagggcaagcctctagtgtaccaagtgcttcctacaaagacgcaaggtgtgctctgagccacagatgggcaaaccctggtgctttccttcatctcccacgaactcaagggttttccaggtgtagctaacagttgccacatcacacagacctcgagtttctggtaagactgctggttgacatcagacccaacccatgaaggctggaaggcagcaggcatttgctaaggcagctgatccaggcaatcgttctgctggccaagaagttaaactattttgagcattagaatggaggaaatccggtcagccaagtgcagagttcagacttcgctaagggcttgtttttcttcagcatttacttgaagattaatgtaggatgacaggctctcctggctgtcctaccatcagctctgccttgcactgtggtcgtcaactttcctcaaatcaaaaacaggcaggtacaggtagtgggctcacaacgtttgacctcgactggtttttctaagttattttgtacatttttcagcagcaaaaccaaactgggtcttcagctttatccccgtttcttgcaagggaagagcctttatacaattggacgcattttggtttttcctcattgagaattcaaatcctcttttgtattgtttctacaataatttgtaaacatatttatttttacctgcttttttttttttttttaattttcaggtcaagttttttatactgcacttatttgtcaaaataaagattctcacatatgccggttatctcgaaa

SEQ ID NO: 222 - protein, 260 aa, Homo sapiens
  mature human Tumor necrosis factor-stimulated gene-6 (TSG-6) protein P98066
WGFKDGIFHNSIWLERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKECGGVFTDPKQIFKSPGFPNEYEDNQICYWHIRLKYGQRIHLSFLDFDLEDDPGCLADYVEIYDSYDDVHGFVGRYCGDELPDDIISTGNVMTLKFLSDASVTAGGFQIKYVAMDPVSKSSQGKNTSTTSTGNKNFLAGRFSHL

SEQ ID NO: 223 - protein, 2570 aa, Homo sapiens
  Stabilin-1 protein Q9NY15
MAGPRGLLPLCLLAFCLAGFSFVRGQVLFKGCDVKTTFVTHVPCTSCAAIKKQTCPSGWLRELPDQITQDCRYEVQLGGSMVSMSGCRRKCRKQVVQKACCPGYWGSRCHECPGGAETPCNGHGTCLDGMDRNGTCVCQENFRGSACQECQDPNRFGPDCQSVCSCVHGVCNHGPRGDGSCLCFAGYTGPHCDQELPVCQELRCPQNTQCSAEAPSCRCLPGYTQQGSECRAPNPCWPSPCSLLAQCSVSPKGQAQCHCPENYHGDGMVCLPKDPCTDNLGGCPSNSTLCVYQKPGQAFCTCRPGLVSINSNASAGCFAFCSPFSCDRSATCQVTADGKTSCVCRESEVGDGRACYGHLLHEVQKATQTGRVFLQLRVAVAMMDQGCREILTTAGPFTVLVPSVSSFSSRTMNASLAQQLCRQHIIAGQHILEDTRTQQTRRWWTLAGQEITVTFNQFTKYSYKYKDQPQQTFNIYKANNIAANGVFHVVTGLRWQAPSGTPGDPKRTIGQILASTEAFSRFETILENCGLPSILDGPGPFTVFAPSNEAVDSLRDGRLIYLFTAGLSKLQELVRYHIYNHGQLTVEKLISKGRILTMANQVLAVNISEEGRILLGPEGVPLQRVDVMAANGVIHMLDGILLPPTILPILPKHCSEEQHKIVAGSCVDCQALNTSTCPPNSVKLDIFPKECVYIHDPTGLNVLKKGCASYCNQTIMEQGCCKGFFGPDCTQCPGGFSNPCYGKGNCSDGIQGNGACLCFPDYKGIACHICSNPNKHGEQCQEDCGCVHGLCDNRPGSGGVCQQGTCAPGFSGRFCNESMGDCGPTGLAQHCHLHARCVSQEGVARCRCLDGFEGDGFSCTPSNPCSHPDRGGCSENAECVPGSLGTHHCTCHKGWSGDGRVCVAIDECELDMRGGCHTDALCSYVGPGQSRCTCKLGFAGDGYQCSPIDPCRAGNGGCHGLATCRAVGGGQRVCTCPPGFGGDGFSCYGDIFRELEANAHFSIFYQWLKSAGITLPADRRVTALVPSEAAVRQLSPEDRAFWLQPRTLPNLVRAHFLQGALFEEELARLGGQEVATLNPTTRWEIRNISGRVWVQNASVDVADLLATNGVLHILSQVLLPPRGDVPGGQGLLQQLDLVPAFSLFRELLQHHGLVPQIEAATAYTIFVPTNRSLEAQGNSSHLDADTVRHHVVLGEALSMETLRKGGHRNSLLGPAHWIVFYNHSGQPEVNHVPLEGPMLEAPGRSLIGLSGVLTVGSSRCLHSHAEALREKCVNCTRRFRCTQGFQLQDTPRKSCVYRSGFSFSRGCSYTCAKKIQVPDCCPGFFGTLCEPCPGGLGGVCSGHGQCQDRFLGSGECHCHEGFHGTACEVCELGRYGPNCTGVCDCAHGLCQEGLQGDGSCVCNVGWQGLRCDQKITSPQCPRKCDPNANCVQDSAGASTCACAAGYSGNGIFCSEVDPCAHGHGGCSPHANCTKVAPGQRTCTCQDGYMGDGELCQEINSCLIHHGGCHIHAECIPTGPQQVSCSCREGYSGDGIRTCELLDPCSKNNGGCSPYATCKSTGDGQRTCTCDTAHTVGDGLTCRARVGLELLRDKHASFFSLRLLEYKELKGDGPFTIFVPHADLMSNLSQDELARIRAHRQLVFRYHVVGCRRLRSEDLLEQGYATALSGHPLRFSEREGSIYLNDFARVVSSDHEAVNGILHFIDRVLLPPEALHWEPDDAPIPRRNVTAAAQGFGYKIFSGLLKVAGLLPLLREASHRPFTMLWPTDAAFRALPPDRQAWLYHEDHRDKLAAILRGHMIRNVEALASDLPNLGPLRTMHGTPISFSCSRTRAGELMVGEDDARIVQRHLPFEGGLAYGIDQLLEPPGLGARCDHFETRPLRLNTCSICGLEPPCPEGSQEQGSPEACWRFYPKFWTSPPLHSLGLRSVWVHPSLWGRPQGLGRGCHRNCVTTTWKPSCCPGHYGSECQACPGGPSSPCSDRGVCMDGMSGSGQCLCRSGFAGTACELCAPGAFGPHCQACRCTVHGRCDEGLGGSGSCFCDEGWTGPRCEVQLELQPVCTPPCAPEAVCRAGNSCECSLGYEGDGRVCTVADLCQDGHGGCSEHANCSQVGTMVTCTCLPDYEGDGWSCRARNPCTDGHRGGCSEHANCLSTGLNTRRCECHAGYVGDGLQCLEESEPPVDRCLGQPPPCHSDAMCTDLHFQEKRAGVFHLQATSGPYGLNFSEAEAACEAQGAVLASFPQLSAAQQLGFHLCLMGWLANGSTAHPVVFPVADCGNGRVGIVSLGARKNLSERWDAYCFRVQDVACRCRNGFVGDGISTCNGKLLDVLAATANFSTFYGMLLGYANATQRGLDFLDFLDDELTYKTLFVPVNEGFVDNMTLSGPDLELHASNATLLSANASQGKLLPAHSGLSLIISDAGPDNSSWAPVAPGTVVVSRIIVWDIMAFNGIIHALASPLLAPPQPQAVLAPEAPPVAAGVGAVLAAGALLGLVAGALYLRARGKPMGFGFSAFQAEDDADDDFSPWQEGTNPTLVSVPNPVFGSDTFCEPFDDSLLEEDFPDTQRILTVK

SEQ ID NO: 224 - protein, 2551 aa, Homo sapiens
  Stabilin-2 protein Q8WWQ8
MMLQHLVIFCLGLVVQNFCSPAETTGQARRCDRKSLLTIRTECRSCALNLGVKCPDGYTMITSGSVGVRDCRYTFEVRTYSLSLPGCRHICRKDYLQPRCCPGRWGPDCIECPGGAGSPCNGRGSCAEGMEGNGTCSCQEGFGGTACETCADDNLFGPSCSSVCNCVHGVCNSGLDGDGTCECYSAYTGPKCDKPIPECAALLCPENSRCSPSTEDENKLECKCLPNYRGDGKYCDPINPCLRKICHPHAHCTYLGPNRHSCTCQEGYRGDGQVCLPVDPCQINFGNCPTKSTVCKYDGPGQSHCECKEHYQNFVPGVGCSMTDICKSDNPCHRNANCTTVAPGRTECICQKGYVGDGLTCYGNIMERLRELNTEPRGKWQGRLTSFISLLDKAYAWPLSKLGPFTVLLPTDKGLKGFNVNELLVDNKAAQYFVKLHIIAGQMNIEYMNNTDMFYTLTGKSGEIFNSDKDNQIKLKLHGGKKKVKIIQGDIIASNGLLHILDRAMDKLEPTFESNNEQTIMTMLQPRYSKFRSLLEETNLGHALDEDGVGGPYTIFVPNNEALNNMKDGTLDYLLSPEGSRKLLELVRYHIVPFTQLEVATLISTPHIRSMANQLIQFNTTDNGQILANDVAMEEIEITAKNGRIYTLTGVLIPPSIVPILPHRCDETKREMKLGTCVSCSLVYWSRCPANSEPTALFTHRCVYSGRFGSLKSGCARYCNATVKIPKCCKGFYGPDCNQCPGGFSNPCSGNGQCADSLGGNGTCICEEGFQGSQCQFCSDPNKYGPRCNKKCLCVHGTCNNRIDSDGACLTGTCRDGSAGRLCDKQTSACGPYVQFCHIHATCEYSNGTASCICKAGYEGDGTLCSEMDPCTGLTPGGCSRNAECIKTGTGTHTCVCQQGWTGNGRDCSEINNCLLPSAGGCHDNASCLYVGPGQNECECKKGFRGNGIDCEPITSCLEQTGKCHPLASCQSTSSGVWSCVCQEGYEGDGFLCYGNAAVELSFLSEAAIFNRWINNASLQPTLSATSNLTVLVPSQQATEDMDQDEKSFWLSQSNIPALIKYHMLLGTYRVADLQTLSSSDMLATSLQGNFLHLAKVDGNITIEGASIVDGDNAATNGVIHIINKVLVPQRRLTGSLPNLLMRLEQMPDYSIFRGYIIQYNLANAIEAADAYTVFAPNNNAIENYIREKKVLSLEEDVLRYHVVLEEKLLKNDLHNGMHRETMLGFSYFLSFFLHNDQLYVNEAPINYTNVATDKGVIHGLGKVLEIQKNRCDNNDTTIIRGRCRTCSSELTCPFGTKSLGNEKRRCIYTSYFMGRRTLFIGCQPKCVRTVITRECCAGFFGPQCQPCPGNAQNVCFGNGICLDGVNGTGVCECGEGFSGTACETCTEGKYGIHCDQACSCVHGRCNQGPLGDGSCDCDVGWRGVHCDNATTEDNCNGTCHTSANCLTNSDGTASCKCAAGFQGNGTICTAINACEISNGGCSAKADCKRTTPGRRVCTCKAGYTGDGIVCLEINPCLENHGGCDKNAECTQTGPNQAACNCLPAYTGDGKVCTLINVCLTKNGGCSEFAICNHTGQVERTCTCKPNYIGDGFTCRGSIYQELPKNPKTSQYFFQLQEHFVKDLVGPGPFTVFAPLSAAFDEEARVKDWDKYGLMPQVLRYHVVACHQLLLENLKLISNATSLQGEPIVISVSQSTVYINNKAKIISSDIISTNGIVHIIDKLLSPKNLLITPKDNSGRILQNLTTLATNNGYIKFSNLIQDSGLLSVITDPIHTPVTLFWPTDQALHALPAEQQDFLFNQDNKDKLKEYLKFHVIRDAKVLAVDLPTSTAWKTLQGSELSVKCGAGRDIGDLFLNGQTCRIVQRELLFDLGVAYGIDCLLIDPTLGGRCDTFTTFDASGECGSCVNTPSCPRWSKPKGVKQKCLYNLPFKRNLEGCRERCSLVIQIPRCCKGYFGRDCQACPGGPDAPCNNRGVCLDQYSATGECKCNTGFNGTACEMCWPGRFGPDCLPCGCSDHGQCDDGITGSGQCLCETGWTGPSCDTQAVLPAVCTPPCSAHATCKENNTCECNLDYEGDGITCTVVDFCKQDNGGCAKVARCSQKGTKVSCSCQKGYKGDGHSCTEIDPCADGLNGGCHEHATCKMTGPGKHKCECKSHYVGDGLNCEPEQLPIDRCLQDNGQCHADAKCVDLHFQDTTVGVFHLRSPLGQYKLTFDKAREACANEAATMATYNQLSYAQKAKYHLCSAGWLETGRVAYPTAFASQNCGSGVVGIVDYGPRPNKSEMWDVFCYRMKDVNCTCKVGYVGDGFSCSGNLLQVLMSFPSLTNFLTEVLAYSNSSARGRAFLEHLTDLSIRGTLFVPQNSGLGENETLSGRDIEHHLANVSMFFYNDLVNGTTLQTRLGSKLLITASQDPLQPTETRFVDGRAILQWDIFASNGIIHVISRPLKAPPAPVTLTHTGLGAGIFFAIILVTGAVALAAYSYFRINRRTIGFQHFESEEDINVAALGKQQPENISNPLYESTTSAPPEPSYDPFTDSEERQLEGNDPLRTL

SEQ ID NO: 225 - protein, 862 aa, Homo sapiens
  CAB61358 protein
GTASCKCAAGFQGNGTICTAINACEISNGGCSAKADCKRTTPGRRVCTCKAGYTGDGIVCLEINPCLENHGGCDKNAECTQTGPNQAACNCLPAYTGDGKVCTLINVCLTKNGGCSEFAICNHTGQVERTCTCKPNYIGDGFTCRGSIYQELPKNPKTSQYFFQLQEHFVKDLVGPGPFTVFAPLSAAFDEEARVKDWDKYGLMPQVLRYHVVACHQLLLENLKLISNATSLQGEPIVISVSQSTVYINNKAKIISSDIISTNGIVHIIDKLLSPKNLLITPKDNSGRILQNLTTLATNNGYIKFSNLIQDSGLLSVITDPIHTPVTLFWPTDQALHALPAEQQDFLFNQDNKDKLKEYLKFHVIRDAKVLAVDLPTSTAWKTLQGSELSVKCGAGRDIGDLFLNGQTCRIVQRELLFDLGVAYGIDCLLIDPTLGGRCDTFTTFDASGECGSCVNTPSCPRWSKPKGVKQKCLYNLPFKRNLEGCRERCSLVIQIPRCCKGYFGRDCQACPGGPDAPCNNRGVCLDQYSATGECKCNTGFNGTACEMCWPGRFGPDCLPCGCSDHGQCDDGITGSGQCLCETGWTGPSCDTQAVLPAVCTPPCSAHATCKENNTCECNLDYEGDGITCTVVDFCKQDNGGCAKVARCSQKGTKVSCSCQKGYKGDGHSCTEIDPCADGLNGGCHEHATCKMTGPGKHKCECKSHYVGDGLNCEPEQLPIDRCLQDNGQCHADAKCVDLHFQDTTVGVFHLRSPLGQYKLTFDKAREACANEAATMATYNQLSYAQKAKYHLCSAGWLETGRVAYPTAFASQNCGSGVVGIVDYGPRPNKSEMWDVFCYRMKGSAGLFQQLSSRPCISRTPD

SEQ ID NO: 226 - protein, 768 aa, Homo sapiens
  KIAA0527 protein AB011099
PRVPQTGGGSLRPASYSPRLPAPSPSAPLYPQSARPSAAPFGTEVSRCPARRRSRVTAASSAPQRRPPGVRRPRRSGSASRASPGSPRSSLSARPARSLRFVSRAQSAEPSGARWAVAWATPNAARALTRVRWPAHSRTMTAEGPSPPARWHRRLPGLWAAALLLLGLPRLSVRADGKLFVLESQNGSQGLQLEAARLSCKSRGAHLASADELRRVVQDCSFAVCTTGWLADGTLGTTVCSKGSGEQQIMRAVDVRIESNPVPGGTYSALCIKDEEKPCGDPPSFPHTILQGRTGLEMGDELLYVCAPGHIMGHRETAFTLLCNSCGEWYGLVQACGKDEAEAHIDYEDNFPDDRSVSFRELMEDSRTEADEDRGQGDSSEEAPKQDRLVSISVGRENIARDKVFVPTTGSPGAGSSVPADSPGSRLLQKHLFWFPAEAFHKPGLEKEVDDDTKKQFSAGDNHSGVKLVPGEPETKVIYGNTDGPSGPFVGKNDSKAGDPVVSSSDESWLDGYPVTDGAWRKTEAEEEEDGDRGDGSVGLDENVLVTPDQPILVEVKKPKSSTLTPSEGMTHSSVLPSQMLDVEALALRPVNASETEGIGDGDLTKYQSTLPWRFITEESPMATLSYELTSSTLEILTVNTVKQTPNHIPSTIMATTQPPVETTVPEIQDSFPYLLSEDFFGQEGPGPGASEELHPTLESCVGDGCPGLSRGPVIATIVTVLCLLLLLAGVGMVWGYRKCQHKSSVYKLNVGQRQARHYHQQIEMEKV

SEQ ID NO: 227 - protein, 742 aa, Homo sapiens
  CD44 protein P16070
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 228 - protein, 322 aa, Homo sapiens
  Lymphatic vessel endothelial hyaluronic acid receptor 1 LYVE-1
MARCFSLVLLLTSIWTTRLLVQGSLRAEELSIQVSCRIMGITLVSKKANQQLNFTEAKEACRLLGLSLAGKDQVETALKASFETCSYGWVGDGFVVISRISPNPKCGKNGVGVLIWKVPVSRQFAAYCYNSSDTWTNSCIPEIITTKDPIFNTQTATQTTEFIVSDSTYSVASPYSTIPAPTTTPPAPASTSIPRRKKLICVTEVFMETSTMSTETEPFVENKAAFKNEAAGFGGVPTALLVLALLFFGAAAGLGFCYVKRYVKAFPFTNKNQQKEMIETKVVKEEKANDSNPNEESKKTDKNPEESKSPSKTTVRCLEAEV

SEQ ID NO: 229 - protein, 354 aa, Homo sapiens
  HAPLN1 Hyaluronan and proteoglycan link protein 1 P10915
MKSLLLLVLISICWADHLSDNYTLDHDRAIHIQAENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVALDLQGVVFPYFPRLGRYNLNFHEAQQACLDQDAVIASFDQLYDAWRGGLDWCNAGWLSDGSVQYPITKPREPCGGQNTVPGVRNYGFWDKDKSRYDVFCFTSNFNGRFYYLIHPTKLTYDEAVQACLNDGAQIAKVGQIFAAWKILGYDRCDAGWLADGSVRYPISRPRRRCSPTEAAVRFVGFPDKKHKLYGVYCFRAYN

SEQ ID NO: 230 - protein, 340 aa, Homo sapiens
  HAPLN2 Hyaluronan and proteoglycan link protein 2 Q9CZV7
MPGWLTLPTLCRFLLWAFTIFHKAQGDPASHPGPHYLLPPIHEVIHSHRGATATLPCVLGTTPPSYKVRWSKVEPGELRETLILITNGLHARGYGPLGGRARMRRGHRLDASLVIAGVRLEDEGRYRCELINGIEDESVALTLSLEGVVFPYQPSRGRYQFNYYEAKQACEEQDGRLATYSQLYQAWTEGLDWCNAGWLLEGSVRYPVLTARAPCGGRGRPGIRSYGPRDRMRDRYDAFCFTSALAGQVFFVPGRLTLSEAHAACRRRGAVVAKVGHLYAAWKFSGLDQCDGGWLADGSVRFPITTPRPRCGGLPDPGVRSFGFPRPQQAAYGTYCYAEN

SEQ ID NO: 231 - protein, 360 aa, Homo sapiens
  HAPLN3 Hyaluronan and proteoglycan link protein 3 Q96S86
MGLLLLVPLLLLPGSYGLPFYNGFYYSNSANDQNLGNGHGKDLLNGVKLVVETPEETLFTYQGASVILPCRYRYEPALVSPRRVRVKWWKLSENGAPEKDVLVAIGLRHRSFGDYQGRVHLRQDKEHDVSLEIQDLRLEDYGRYRCEVIDGLEDESGLVELELRGVVFPYQSPNGRYQFNFHEGQQVCAEQAAVVASFEQLFRAWEEGLDWCNAGWLQDATVQYPIMLPRQPCGGPGLAPGVRSYGPRHRRLHRYDVFCFATALKGRVYYLEHPEKLTLTEAREACQEDDATIAKVGQLFAAWKFHGLDRCDAGWLADGSVRYPVVHPHPNCGPPEPGVRSFGFPDPQSRLYGVYCYRQH

SEQ ID NO: 232 - protein, 402 aa, Homo sapiens
  HAPLN4 Hyaluronan and proteoglycan link protein 4 Q86UW8
MVCARAALGPGALWAAAWGVLLLTAPAGAQRGRKKVVHVLEGESGSVVVQTAPGQVVSHRGGTIVLPCRYHYEAAAHGHDGVRLKWTKVVDPLAFTDVFVALGPQHRAFGSYRGRAELQGDGPGDASLVLRNVTLQDYGRYECEVTNELEDDAGMVKLDLEGVVFPYHPRGGRYKLTFAEAQRACAEQDGILASAEQLHAAWRDGLDWCNAGWLRDGSVQYPVNRPREPCGGLGGTGSAGGGGDANGGLRNYGYRHNAEERYDAFCFTSNLPGRVFFLKPLRPVPFSGAARACAARGAAVAKVGQLFAAWKLQLLDRCTAGWLADGSARYPIVNPRARCGGRRPGVRSLGFPDATRRLFGVYCYRAPGAPDPAPGGWGWGWAGGGGWAGGARDPAAWTPLHV

SEQ ID NO: 233 - protein, 2431 aa, Homo sapiens
  human Aggrecan protein P16112
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATLATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAATEESTEGPSATEVPSASEEPSPSEVPFPSEEPSPSEEPFPSVRPFPSVELFPSEEPFPSKEPSPSEEPSASEEPYTPSPPVPSWTELPSSGEESGAPDVSGDFTGSGDVSGHLDFSGQLSGDRASGLPSGDLDSSGLTSTVGSGLPVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGLPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGISGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDISGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAADQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTATTYKRRLQKRSSRHPRRSRPSTAH

SEQ ID NO: 234 - protein, 911 aa, Homo sapiens
  human Brevican protein Q96GW7
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 235 - protein, 2376 aa, Homo sapiens
  human Versican protein P13611
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLEPSEDDGKPELLEEMEASPTELIAVEGTEILQDFQNKTDGQVSGEAIKMFPTIKTPEAGTVITTADEIELEGATQWPHSTSASATYGVEAGVVPWLSPQTSERPTLSSSPEINPETQAALIRGQDSTIAASEQQVAARILDSNDQATVNPVEFNTEVATPPFSLLETSNETDFLIGINEESVEGTAIYLPGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 236 - protein, 1321 aa, Homo sapiens
  human Neurocan protein O15494
MGAPFVWALGLLMLQMLLFVAGEQGTQDITDASERGLHMQKLGSGSVQAALAELVALPCLFTLQPRPSAARDAPRIKWTKVRTASGQRQDLPILVAKDNVVRVAKSWQGRVSLPSYPRRRANATLLLGPLRASDSGLYRCQVVRGIEDEQDLVPLEVTGVVFHYRSARDRYALTFAEAQEACRLSSAIIAAPRHLQAAFEDGFDNCDAGWLSDRTVRYPITQSRPGCYGDRSSLPGVRSYGRRNPQELYDVYCFARELGGEVFYVGPARRLTLAGARAQCRRQGAALASVGQLHLAWHEGLDQCDPGWLADGSVRYPIQTPRRRCGGPAPGVRTVYRFANRTGFPSPAERFDAYCFRAHHPTSQHGDLETPSSGDEGEILSAEGPPVRELEPTLEEEEVVTPDFQEPLVSSGEEETLILEEKQESQQTLSPTPGDPMLASWPTGEVWLSTVAPSPSDMGAGTAASSHTEVAPTDPMPRRRGRFKGLNGRYFQQQEPEPGLQGGMEASAQPPTSEAAVNQMEPPLAMAVTEMLGSGQSRSPWADLTNEVDMPGAGSAGGKSSPEPWLWPPTMVPPSISGHSRAPVLELEKAEGPSARPATPDLFWSPLEATVSAPSPAPWEAFPVATSPDLPMMAMLRGPKEWMLPHPTPISTEANRVEAHGEATATAPPSPAAETKVYSLPLSLTPTGQGGEAMPTTPESPRADFRETGETSPAQVNKAEHSSSSPWPSVNRNVAVGFVPTETATEPTGLRGIPGSESGVFDTAESPTSGLQATVDEVQDPWPSVYSKGLDASSPSAPLGSPGVFLVPKVTPNLEPWVATDEGPTVNPMDSTVTPAPSDASGIWEPGSQVFEEAESTTLSPQVALDTSIVTPLTTLEQGDKVGVPAMSTLGSSSSQPHPEPEDQVETQGTSGASVPPHQSSPLGKPAVPPGTPTAASVGESASVSSGEPTVPWDPSSTLLPVTLGIEDFELEVLAGSPGVESFWEEVASGEEPALPGTPMNAGAEEVHSDPCENNPCLHGGTCNANGTMYGCSCDQGFAGENCEIDIDDCLCSPCENGGTCIDEVNGFVCLCLPSYGGSFCEKDTEGCDRGWHKFQGHCYRYFAHRRAWEDAEKDCRRRSGHLTSVHSPEEHSFINSFGHENTWIGLNDRIVERDFQWTDNTGLQFENWRENQPDNFFAGGEDCVVMVAHESGRWNDVPCNYNLPYVCKKGTVLCGPPPAVENASLIGARKAKYNVHATVRYQCNEGFAQHHVATIRCRSNGKWDRPQIVCTKPRRSHRMRRHHHHHQHHHQHHHHKSRKERRKHKKHPTEDWEKDEGNFC

SEQ ID NO: 237 - protein, 2316 aa, Rattus norvegicus
  rat Phosphacan Q62656
MRILQSFLACVQLLCVCRLDWAYGYYRQQRKLVEEIGWSYTGALNQKNWGKKYPICNSPKQSPINIDEDLTQVNVNLKKLKFQGWEKPSLENTFIHNTGKTVEINLTNDYYLSGGLSEKVFKASKMTFHWGKCNVSSEGSEHSLEGQKFPLEMQIYCFDADRFSSFEETVKGKGRLRALSILFEIGVEENLDYKAIIDGTESVSRFGKQAALDPFILQNLLPNSTDKYYIYNGSLTSPPCTDTVEWIVFKDTVSISESQLAVFCEVLTMQQSGYVMLMDYLQNNFREQQYKFSRQVFSSYTGKEEIHEAVCSSEPENVQADPENYTSLLITWERPRVVYDTMIEKFAVLYQPLEGNDQTKHEFLTDGYQDLGAILNNLIPNMSYVLQIVAICSNGLYGKYSDQLIVDMPTEDAELDLFPELIGTEEIIKEENYGKGNEEDTGLNPGRDSATNQIRKKEPQVSTTTHYNHMGTKYNEAKTNRSPTRGSEFSGKSDVLNTSLNPTSQQVAEFNPEREMSLPSQIGTNLPPHSVEGTSASLNSGSKTLLVFPQMNLSGTAESLNMVSITEYKEVSADLSEEENLLTDFKLDSGADDSSGSSPASSTVPFSTDNLSHGYTSSSDTPEAVTYDVLRPESTRNALEDSAPSGSEESLKDPSLEGSVWFPGSTDLTTQSETGSGREGFLQVNSTDFQVDESRETTETFSPDATASRGPSVTDMEMPHYSTFAYPPTEVTSHAFTPSSRPLDLAPTSNILHSQTTQPVYNGETPLQPSYSSEVFPLVTPLLLDNQTLNTTPAASSSDSALHATPVFPSVGVSFDSILSSYDDAPLLPFSSASFSSDLFHHLHTVSQTLPQVTSAAERDELSLHASLLVAGGDLLLEPSLVQYSDVMSHQVTIHAASDTLEFGSESAVLYKTSMVSQIESPSSDVVMHAYSSGPETSYAIEGSHHVLTVSSSSAIPVHDSVGVADQGSLLINPSHISLPESSFITPTASLLQLPPALSGDGEWSGASSDSELLLPDTDGLRTLNMSSPVSVADFTYTTSVSGDDIKPLSKGEMMYGNETELKMSSFSDMAYPSKSTVVPKMSDIVNKWSESLKETSVSVSSINSVFTESLVYPITKVFDQEISRVPEIIFPVKPTHTASQASGDTWLKPGLSTNSEPALSDTASSEVSHPSTQPLLYEAASPFNTEALLQPSFPASDVDTLLKTALPSGPRDPVLTETPMVEQSSSSVSLPLASESASSKSTLHFTSVPVLNMSPSDVHPTSLQRLTVPHSREEYFEQGLLKSKSPQQVLPSLHSHDEFFQTAHLDISQAYPPKGRHAFATPILSINEPQNTLINRLVYSEDIFMHPEISITDKALTGLPTTVSDVLIATDHSVPLGSGPISMTTVSPNRDDSVTTTKLLLPSKATSKPTHSARSDADLVGGGEDGDDYDDDDYDDIDSDRFPVNKCMSCSPYRESQEKVMNDSDTQESSLVDQSDPISHLLSENTEEENGGTGVTRVDKSPDKSPPPSMLPQKHNDGREDRDIQMGSAVLPHTPGSKAWAVLTSDEESGSGQGTSDSLNDNETSTDFSFPDVNEKDADGVLEADDTGIAPGSPRSSTPSVTSGHSGVSNSSEAEASNSSHESRIGLAEGLESEKKAVIPLVIVSALTFICLVVLVGILIYWRKCFQTAHFYLEDNTSPRVISTPPTPIFPISDDIGAIPIKHFPKHVADLHASNGFTEEFETLKEFYQEVQSCTVDLGITADSSNHPDNKHKNRYVNIVAYDHSRVKLTQLAEKDGKLTDYINANYVDGYNRPKAYIAAQGPLKSTAEDFWRMIWEHNVEVIVMITNLVEKGRRKCDQYWPTDGSEEYGSFLVNQKNVQVLAYYTVRNFTLRNTKIKKGSQKGRSSGRLVTQYHYTQWPDMGVPEYSLPVLAFVRKTAQAKRHAVGPVVVHCSAGVGRTGTYIVLDSMLQQIQHEGTVNIFGFLKHIRSQRNYLVQTEEQYVFIHDTLVEAILSKETEVPDSHIHSYVNTLLIPGPSGKTKLEKQFQLLSQSNILQSDYSTALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMSEEHKCLSNEEKLIVQDFILEATQDDYVLEVRHFQCPKWPNPDSPISKTFELISIIKEEAANRDGPMIVHDEHGGVTAGTFCALTTLMHQLEKENSMDVYQVAKMINLMRPGVFTDIEQYQFLYKVVLSLVSTRQEENPSTSLDSNGAALPDGNIAESLESLV

SEQ ID NO: 238 - protein, 382 aa, Homo sapiens
  Layilin Isoform 1  Q6UX15
MRPGTALQAVLLAVLLVGLRAATGRLLSASDLDLRGGQPVCRGGTQRPCYKVIYFHDTSRRLNFEEAKEACRRDGGQLVSIESEDEQKLIEKFIENLLPSDGDFWIGLRRREEKQSNSTACQDLYAWTDGSISQFRNWYVDEPSCGSEVCVVMYHQPSAPAGIGGPYMFQWNDDRCNMKNNFICKYSDEKPAVPSREAEGEETELTTPVLPEETQEEDAKKTFKESREAALNLAYILIPSIPLLLLLVVTTVVCWVWICRKRKREQPDPSTKKQHTIWPSPHQGNSPDLEVYNVIRKQSEADLAETRPDLKNISFRVCSGEATPDDMSCDYDNMAVNPSESGFVTLVSVESGFVTNDIYEFSPDQMGRSKESGWVENEIYGY

SEQ ID NO: 239 - protein, 374 aa, Homo sapiens
  Layilin Isoform 2  NP_849156
MRPGTALQAVLLAVLLVGLRAATGRLLSGQPVCRGGTQRPCYKVIYFHDTSRRLNFEEAKEACRRDGGQLVSIESEDEQKLIEKFIENLLPSDGDFWIGLRRREEKQSNSTACQDLYAWTDGSISQFRNWYVDEPSCGSEVCVVMYHQPSAPAGIGGPYMFQWNDDRCNMKNNFICKYSDEKPAVPSREAEGEETELTTPVLPEETQEEDAKKTFKESREAALNLAYILIPSIPLLLLLVVTTVVCWVWICRKRKREQPDPSTKKQHTIWPSPHQGNSPDLEVYNVIRKQSEADLAETRPDLKNISFRVCSGEATPDDMSCDYDNMAVNPSESGFVTLVSVESGFVTNDIYEFSPDQMGRSKESGWVENEIYGY

SEQ ID NO: 240 - protein, 282 aa, Homo sapiens
  HABP1/C1QBP  Q07021
MLPLLRCVPRVLGSSVAGLRAAAPASPFRQLLQPAPRLCTRPFGLLSVRAGSERRPGLLRPRGPCACGCGCGSLHTDGDKAFVDFLSDEIKEERKIQKHKTLPKMSGGWELELNGTEAKLVRKVAGEKITVTFNINNSIPPTFDGEEEPSQGQKVEEQEPELTSTPNFVVEVIKNDDGKKALVLDCHYPEDEVGQEDEAESDIFSIREVSFQSTGESEWKDTNYTLNTDSLDWALYDHLMDFLADRGVDNTFADELVELSTALEHQEYITFLEDLKSFVKSQ

SEQ ID NO: 241 - protein, 12 aa, Homo sapiens
  PEP-1
GAHWQFNALTVR

SEQ ID NO: 242 - protein, 724 aa, Homo sapiens
  human Rhamm protein O75330
MSFPKAPLKRFNDPSGCAPSPGAYDVKTLEVLKGPVSFQKSQRFKQQKESKQNLNVDKDTTLPASARKVKSSESKESQKNDKDLKILEKEIRVLLQERGAQDRRIQDLETELEKMEARLNAALREKTSLSANNATLEKQLIELTRTNELLKSKFSENGNQKNLRILSLELMKLRNKRETKMRGMMAKQEGMEMKLQVTQRSLEESQGKIAQLEGKLVSIEKEKIDEKSETEKLLEYIEEISCASDQVEKYKLDIAQLEENLKEKNDEILSLKQSLEENIVILSKQVEDLNVKCQLLEKEKEDHVNRNREHNENLNAEMQNLKQKFILEQQEREKLQQKELQIDSLLQQEKELSSSLHQKLCSFQEEMVKEKNLFEEELKQTLDELDKLQQKEEQAERLVKQLEEEAKSRAEELKLLEEKLKGKEAELEKSSAAHTQATLLLQEKYDSMVQSLEDVTAQFESYKALTASEIEDLKLENSSLQEKAAKAGKNAEDVQHQILATESSNQEYVRMLLDLQTKSALKETEIKEITVSFLQKITDLQNQLKQQEEDFRKQLEDEEGRKAEKENTTAELTEEINKWRLLYEELYNKTKPFQLQLDAFEVEKQALLNEHGAAQEQLNKIRDSYAKLLGHQNLKQKIKHVVKLKDENSQLKSEVSKLRCQLAKKKQSETKLQEELNKVLGIKHFDPSKAFHHESKENFALKTPLKEGNTNCYRAPMECQESWK

SEQ ID NO: 243 - protein, 911 aa, Homo sapiens
  Inter alpha trypsin inhibitor heavy chain 1 P19827
MDGAMGPRGLLLCMYLVSLLILQAMPALGSATGRSKSSEKRQAVDTAVDGVFIRSLKVNCKVTSRFAHYVVTSQVVNTANEAREVAFDLEIPKTAFISDFAVTADGNAFIGDIKDKVTAWKQYRKAAISGENAGLVRASGRTMEQFTIHLTVNPQSKVTFQLTYEEVLKRNHMQYEIVIKVKPKQLVHHFEIDVDIFEPQGISKLDAQASFLPKELAAQTIKKSFSGKKGHVLFRPTVSQQQSCPTCSTSLLNGHFKVTYDVSRDKICDLLVANNHFAHFFAPQNLTNMNKNVVFVIDISGSMRGQKVKQTKEALLKILGDMQPGDYFDLVLFGTRVQSWKGSLVQASEANLQAAQDFVRGFSLDEATNLNGGLLRGIEILNQVQESLPELSNHASILIMLTDGDPTEGVTDRSQILKNVRNAIRGRFPLYNLGFGHNVDFNFLEVMSMENNGRAQRIYEDHDATQQLQGFYSQVAKPLLVDVDLQYPQDAVLALTQNHHKQYYEGSEIVVAGRIADNKQSSFKADVQAHGEGQEFSITCLVDEEEMKKLLRERGHMLENHVERLWAYLTIQELLAKRMKVDREERANLSSQALQMSLDYGFVTPLTSMSIRGMADQDGLKPTIDKPSEDSPPLEMLGPRRTFVLSALQPSPTHSSSNTQRLPDRVTGVDTDPHFIIHVPQKEDTLCFNINEEPGVILSLVQDPNTGFSVNGQLIGNKARSPGQHDGTYFGRLGIANPATDFQLEVTPQNITLNPGFGGPVFSWRDQAVLRQDGVVVTINKKRNLVVSVDDGGTFEVVLHRVWKGSSVHQDFLGFYVLDSHRMSARTHGLLGQFFHPIGFEVSDIHPGSDPTKPDATMVVRNRRLTVTRGLQKDYSKDPWHGAEVSCWFIHNNGAGLIDGAYTDYIVPDIF

SEQ ID NO: 244 - protein, 946 aa, Homo sapiens
  Inter alpha trypsin inhibitor heavy chain 2 P19823
MKRLTCFFICFFLSEVSGFEIPINGLSEFVDYEDLVELAPGKFQLVAENRRYQRSLPGESEEMMEEVDQVTLYSYKVQSTITSRMATTMIQSKVVNNSPQPQNVVFDVQIPKGAFISNFSMTVDGKTFRSSIKEKTVGRALYAQARAKGKTAGLVRSSALDMENFRTEVNVLPGAKVQFELHYQEVKWRKLGSYEHRIYLQPGRLAKHLEVDVWVIEPQGLRFLHVPDTFEGHFDGVPVISKGQQKAHVSFKPTVAQQRICPNCRETAVDGELVVLYDVKREEKAGELEVFNGYFVHFFAPDNLDPIPKNILFVIDVSGSMWGVKMKQTVEAMKTILDDLRAEDHFSVIDFNQNIRTWRNDLISATKTQVADAKRYIEKIQPSGGTNINEALLRAIFILNEANNLGLLDPNSVSLIILVSDGDPTVGELKLSKIQKNVKENIQDNISLFSLGMGFDVDYDFLKRLSNENHGIAQRIYGNQDTSSQLKKFYNQVSTPLLRNVQFNYPHTSVTDVTQNNFHNYFGGSEIVVAGKFDPAKLDQIESVITATSANTQLVLETLAQMDDLQDFLSKDKHADPDFTRKLWAYLTINQLLAERSLAPTAAAKRRITRSILQMSLDHHIVTPLTSLVIENEAGDERMLADAPPQDPSCCSGALYYGSKVVPDSTPSWANPSPTPVISMLAQGSQVLESTPPPHVMRVENDPHFIIYLPKSQKNICFNIDSEPGKILNLVSDPESGIVVNGQLVGAKKPNNGKLSTYFGKLGFYFQSEDIKIEISTETITLSHGSSTFSLSWSDTAQVTNQRVQISVKKEKVVTITLDKEMSFSVLLHRVWKKHPVNVDFLGIYIPPTNKFSPKAHGLIGQFMQEPKIHIFNERPGKDPEKPEASMEVKGQKLIITRGLQKDYRTDLVFGTDVTCWFVHNSGKGFIDGHYKDYFVPQLYSFLKRP

SEQ ID NO: 245 - protein, 890 aa, Homo sapiens
  Inter alpha trypsin inhibitor heavy chain 3 Q06033
MAFAWWPCLILALLSSLAASGFPRSPFRLLGKRSLPEGVANGIEVYSTKINSKVTSRFAHNVVTMRAVNRADTAKEVSFDVELPKTAFITNFTLTIDGVTYPGNVKEKEVAKKQYEKAVSQGKTAGLVKASGRKLEKFTVSVNVAAGSKVTFELTYEELLKRHKGKYEMYLKVQPKQLVKHFEIEVDIFEPQGISMLDAEASFITNDLLGSALTKSFSGKKGHVSFKPSLDQQRSCPTCTDSLLNGDFTITYDVNRESPGNVQIVNGYFVHFFAPQGLPVVPKNVAFVIDISGSMAGRKLEQTKEALLRILEDMQEEDYLNFILFSGDVSTWKEHLVQATPENLQEARTFVKSMEDKGMTNINDGLLRGISMLNKAREEHRIPERSTSIVIMLTDGDANVGESRPEKIQENVRNAIGGKFPLYNLGFGNNLNYNFLENMALENHGFARRIYEDSDADLQLQGFYEEVANPLLTGVEMEYPENAILDLTQNTYQHFYDGSEIVVAGRLVDEDMNSFKADVKGHGATNDLTFTEEVDMKEMEKALQERDYIFGNYIERLWAYLTIEQLLEKRKNAHGEEKENLTARALDLSLKYHFVTPLTSMVVTKPEDNEDERAIADKPGEDAEATPVSPAMSYLTSYQPPQNPYYYVDGDPHFIIQIPEKDDALCFNIDEAPGTVLRLIQDAVTGLTVNGQITGDKRGSPDSKTRKTYFGKLGIANAQMDFQVEVTTEKITLWNRAVPSTFSWLDTVTVTQDGLSMMINRKNMVVSFGDGVTFVVVLHQVWKKHPVHRDFLGFYVVDSHRMSAQTHGLLGQFFQPFDFKVSDIRPGSDPTKPDATLVVKNHQLIVTRGSQKDYRKDASIGTKVVCWFVHNNGEGLIDGVHTDYIVPNLF

SEQ ID NO: 246 - protein, 797 aa, Homo sapiens
  human SPACR protein Q17R60
MYLETRRAIFVFWIFLQVQGTKDISINIYHSETKDIDNPPRNETTESTEKMYKMSTMRRIFDLAKHRTKRSAFFPTGVKVCPQESMKQILDSLQAYYRLRVCQEAVWEAYRIFLDRIPDTGEYQDWVSICQQETFCLFDIGKNFSNSQEHLDLLQQRIKQRSFPDRKDEISAEKTLGEPGETIVISTDVANVSLGPFPLTPDDTLLNEILDNTLNDTKMPTTERETEFAVLEEQRVELSVSLVNQKFKAELADSQSPYYQELAGKSQLQMQKIFKKLPGFKKIHVLGFRPKKEKDGSSSTEMQLTAIFKRHSAEAKSPASDLLSFDSNKIESEEVYHGTMEEDKQPEIYLTATDLKRLISKALEEEQSLDVGTIQFTDEIAGSLPAFGPDTQSELPTSFAVITEDATLSPELPPVEPQLETVDGAEHGLPDTSWSPPAMASTSLSEAPPFFMASSIFSLTDQGTTDTMATDQTMLVPGLTIPTSDYSAISQLALGISHPPASSDDSRSSAGGEDMVRHLDEMDLSDTPAPSEVPELSEYVSVPDHFLEDTTPVSALQYITTSSMTIAPKGRELVVFFSLRVANMAFSNDLFNKSSLEYRALEQQFTQLLVPYLRSNLTGFKQLEILNFRNGSVIVNSKMKFAKSVPYNLTKAVHGVLEDFRSAAAQQLHLEIDSYSLNIEPADQADPCKFLACGEFAQCVKNERTEEAECRCKPGYDSQGSLDGLEPGLCGPGTKECEVLQGKGAPCRLPDHSENQAYKTSVKKFQNQQNNKVISKRNSELLTVEYEEFNHQDWEGN

SEQ ID NO: 247 - protein, 1241 aa, Homo sapiens
  human SPACRCAN protein Q9BZV3
MIMFPLFGKISLGILIFVLIEGDFPSLTAQTYLSIEEIQEPKSAVSFLLPEESTDLSLATKKKQPLDRRETERQWLIRRRRSILFPNGVKICPDESVAEAVANHVKYFKVRVCQEAVWEAFRTFWDRLPGREEYHYWMNLCEDGVTSIFEMGTNFSESVEHRSLIMKKLTYAKETVSSSELSSPVPVGDTSTLGDTTLSVPHPEVDAYEGASESSLERPEESISNEIENVIEEATKPAGEQIAEFSIHLLGKQYREELQDSSSFHHQHLEEEFISEVENAFTGLPGYKEIRVLEFRSPKENDSGVDVYYAVTFNGEAISNTTWDLISLHSNKVENHGLVELDDKPTVVYTISNFRDYIAETLQQNFLLGNSSLNPDPDSLQLINVRGVLRHQTEDLVWNTQSSSLQATPSSILDNTFQAAWPSADESITSSIPPLDFSSGPPSATGRELWSESPLGDLVSTHKLAFPSKMGLSSSPEVLEVSSLTLHSVTPAVLQTGLPVASEERTSGSHLVEDGLANVEESEDFLSIDSLPSSSFTQPVPKETIPSMEDSDVSLTSSPYLTSSIPFGLDSLTSKVKDQLKVSPFLPDASMEKELIFDGGLGSGSGQKVDLITWPWSETSSEKSAEPLSKPWLEDDDSLLPAEIEDKKLVLVDKMDSTDQISKHSKYEHDDRSTHFPEEEPLSGPAVPIFADTAAESASLTLPKHISEVPGVDDYSVTKAPLILTSVAISASTDKSDQADAILREDMEQITESSNYEWFDSEVSMVKPDMQTLWTILPESERVWTRTSSLEKLSRDILASTPQSADRLWLSVTQSTKLPPTTISTLLEDEVIMGVQDISLELDRIGTDYYQPEQVQEQNGKVGSYVEMSTSVHSTEMVSVAWPTEGGDDLSYTQTSGALVVFFSLRVTNMMFSEDLFNKNSLEYKALEQRFLELLVPYLQSNLTGFQNLEILNFRNGSIVVNSRMKFANSVPPNVNNAVYMILEDFCTTAYNTMNLAIDKYSLDVESGDEANPCKFQACNEFSECLVNPWSGEAKCRCFPGYLSVEERPCQSLCDLQPDFCLNDGKCDIMPGHGAICRCRVGENWWYRGKHCEEFVSEPVIIGITIASVVGLLVIFSAIIYFFIRTLQAHHDRSERESPFSGSSRQPDSLSSIENAVKYNPVYESHRAGCEKYEGPYPQHPFYSSASGDVIGGLSREEIRQMYESSELSREEIQERMRVLELYANDPEFAAFVREQQVEEV

SEQ ID NO: 248 - protein, 300 aa, Homo sapiens
  human CD38 protein P28907
MANCEFSPVSGDKPCCRLSRRAQLCLGVSILVLILVVVLAVVVPRWRQQWSGPGTTKRFPETVLARCVKYTEIHPEMRHVDCQSVWDAFKGAFISKHPCNITEEDYQPLMKLGTQTVPCNKILLWSRIKDLAHQFTQVQRDMFTLEDTLLGYLADDLTWCGEFNTSKINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYRPDKFLQCVKNPEDSSCTSEI

SEQ ID NO: 249 - protein, 413 aa, Homo sapiens
  Intracellular hyaluronan-binding protein 4  Q5JVS0
MKGALGSPVAAAGAAMQESFGCVVANRFHQLLDDESDPFDILREAERRRQQQLQRKRRDEAAAAAGAGPRGGRSPAGASGHRAGAGGRRESQKERKSLPAPVAQRPDSPGGGLQAPGQKRTPRRGEQQGWNDSRGPEGMLERAERRSYREYRPYETERQADFTAEKFPDEKPGDRFDRDRPLRGRGGPRGGMRGRGRGGPGNRVFDAFDQRGKREFERYGGNDKIAVRTEDNMGGCGVRTWGSGKDTSDVEPTAPMEEPTVVEESQGTPEEESPAKVPELEVEEETQVQEMTLDEWKNLQEQTRPKPEFNIRKPESTVPSKAVVIHKSKYRDDMVKDDYEDDSHVFRKPANDITSQLEINFGNLPRPGRGARGGTRGGRGRIRRAENYGPRAEVVMQDVAPNPDDPEDFPALS

SEQ ID NO: 250 - protein, 378 aa, Homo sapiens
  human CDC37 protein Q16543
MVDYSVWDHIEVSDDEDETHPNIDTASLFRWRHQARVERMEQFQKEKEELDRGCRECKRKVAECQRKLKELEVAEGGKAELERLQAEAQQLRKEERSWEQKLEEMRKKEKSMPWNVDTLSKDGFSKSMVNTKPEKTEEDSEEVREQKHKTFVEKYEKQIKHFGMLRRWDDSQKYLSDNVHLVCEETANYLVIWCIDLEVEEKCALMEQVAHQTIVMQFILELAKSLKVDPRACFRQFFTKIKTADRQYMEGFNDELEAFKERVRGRAKLRIEKAMKEYEEEERKKRLGPGGLDPVEVYESLPEELQKCFDVKDVQMLQDAISKMDPTDAKYHMQRCIDSGLWVPNSKASEAKEGEEAGPGDPLLEAVPKTGDEKDVSV

SEQ ID NO: 251 - protein, 560 aa, Homo sapiens
  Hyaluronan-binding protein 2 PHBP  Q14520
MFARMSDLHVLLLMALVGKTACGFSLMSLLESLDPDWTPDQYDYSYEDYNQEENTSSTLTHAENPDWYYTEDQADPCQPNPCEHGGDCLVHGSTFTCSCLAPFSGNKCQKVQNTCKDNPCGRGQCLITQSPPYYRCVCKHPYTGPSCSQVVPVCRPNPCQNGATCSRHKRRSKFTCACPDQFKGKFCEIGSDDCYVGDGYSYRGKMNRTVNQHACLYWNSHLLLQENYNMFMEDAETHGIGEHNFCRNPDADEKPWCFIKVTNDKVKWEYCDVSACSAQDVAYPEESPTEPSTKLPGFDSCGKTEIAERKIKRIYGGFKSTAGKHPWQASLQSSLPLTISMPQGHFCGGALIHPCWVLTAAHCTDIKTRHLKVVLGDQDLKKEEFHEQSFRVEKIFKYSHYNERDEIPHNDIALLKLKPVDGHCALESKYVKTVCLPDGSFPSGSECHISGWGVTETGKGSRQLLDAKVKLIANTLCNSRQLYDHMIDDSMICAGNLQKPGQDTCQGDSGGPLTCEKDGTYYVYGIVSWGLECGKRPGVYTQVTKFLNWIKATIKSESGF

SEQ ID NO: 252 - protein, 275 aa, Mus musculus
  Mouse TSG-6  O08859
MVVLLCLCVLLWEEAHGWGFKNGIFHNSIWLEQAAGVYHREARAGRYKLTYAEAKAVCEFEGGRLATYKQLEAARKIGFHVCAAGWMAKGRVGYPIVKPGPNCGFGKTGIIDYGIRLNRSERWDAYCYNPHAKECGGVFTDPKRIFKSPGFPNEYDDNQVCYWHIRLKYGQRIHLSFLDFDLEHDPGCLADYVEIYDSYDDVHGFVGRYCGDELPEDIISTGNVMTLKFLSDASVTAGGFQIKYVTVDPASKSSQAKNTSTTGNKKFLPGRFSHL

SEQ ID NO: 253 - protein, 276 aa, Oryctolagus cuniculus
  Rabbit TSG-6 P98065
MIILIYLFVLVWEEAQGWGFKNGIFHNSIWLEQAAGVYHREARSGKYKLTYAEAKAVCEFEGGRLATYKQLEAARKIGFHVCAAGWMAKGRVGYPIVKPGSNCGFGKTGIIDYGIRLNRSERWDAYCYNPHAKECGGVFTDPKRIFKSPGFPNEYDDNQICYWHIRLKYGQRIHLSFLNFDLEYDPGCLADYVEIYDSYDDVHGFVGRYCGDELPEDIISTGNVMTLKFLSDASVTAGGFQIKYVTVDPASKSSQGKNTSTVSGNKNFLAGRFSHL

SEQ ID NO: 254 - protein, 280 aa, Bos taurus
  Cow TSG-6  Q5W1C4
MIILIYLFVLLWEEAHGWGFKNGIFHNSIWLEQAAGVYHREARSGKYKLTYAEAKAVCEYEGGHLATYKQLEAARKIGFHVCAAGWMAKGRVGYPIVKPGPNCGFGKTGIIDYGIRLNRSERWDAYCYNPHAKECGGVFTDPKRIFKSPGFPNEYDDNQICYWHIRLKYGQRIHLSFLDFDLEDDPACLADYVEVYDSYDDVHGFVGRYCGDELPEDIISTGNVMTLKFLSDASVTAGGFQIKYVAVDPVSKSSQGKNASTTSTTSTGNKNFLAGRFSHL

SEQ ID NO: 255 - protein, 2571 aa, Mus musculus
  Mouse Stabilin-1  Q8R4Y4
MAEPRTLLLLCVLVLCLSDSSFIRGQTVRSKRCDIHTKFVTHTPCTACAAIRRQLCPWGWSRNFPEKILLDCRYELQLRGAAISLSGCSQECWKDVVQKACCPGYWGSQCFECPGGPATPCSGHGTCLDGIEGNGTCVCQGNFSGSVCQECRDPNRFGPDCQSVCNCVHGVCSHGPRGDGSCRCFAGYTGPHCDQELPVCQSLKCPQNSQCSAEAPTCKCLPGYTQQDNVCLAPDPCQPSACSPLARCSVTPQGQAQCQCPENYHGDGKVCLPRDPCLTNFGGCPSNSTFCLYRGPGKATCMCRPGMTSINNNASEGCHVSCKPHSCDRSATCQVTPDRKTSCVCKNDEVGDGHACYGHLLHEVRRANQNGLVFLRLRAAIAMLEQGCQEILTTSGPFTVLVPSMFSVSSVSSNMNATLAQQLCRQHVIAGEHMLENAGPPSTRRWWTLAGQEVTITFKNMRYAYKYEDQPQQFSIHKANYIAANGVFHTVTALRWQLPPPLPGDSKKTVGQILASTEVFTRFETILENCGLPSILDGPGPFTVFAPSNEAVDSLRDGRLIYLFTAGLSKLQELVRYHIYNHGQLTVEKLISKGRVLTMANQVLTVNISEGGRILLGPGGIPVRRVDVPAANGVIHMLEGILLPPTILPILPKHCDEEQHQTVLGSCVDCQALNTSVCPPNSVKMDIFPKECVYIHDPNGLNVLKKGCADYCNQTITKRGCCKGFFGPDCTQCPGGFSNPCYGKGNCSDGVRGNGACLCFPDYKGIACHICSDPKKHGEQCQEDCGCVHGLCDNRPGSGGVCQQGTCAPGFQGRFCNESMGNCGSTGLAQPCHSDAHCVIQEGVARCVCHDGFEGNGFSCKRSNPCSRPDRGGCSENAECVPGDLGTHHCICHKGWSGDGRICVAIDECGLDTRGGCHADALCSYVGPGQSRCTCKLGFAGNGYECSPIDPCRVGNGGCHGLATCKAVGGGQRVCTCPPHFGGDGFSCYGDIIQELEANAHFSAFSQWFKNSSITLPADSRVTALVPSESAIRRLSLEDQAFWLQPKMLPELARAHFLQGAFSEEELARLNGQQVATLSATTRWQIHNISGKVWVQNATVDVPDLLATNGILHIVSQVLLPPRGDMQTGPGLLQQLDSVPAFRLFGEQLKHHKLVAQIEAAKAYTIFVPTNHSLETQGNNSVLGIDTVRHHVILGEALSVEVLRKGGHRNSLLGPAHWLVFYNHSGQPEVNHMPLEGPLLEAPGSSLFGLSGILAVGSSRCLHSHAEALREKCINCTRKFRCTQGFQLQDTPRKSCVYRSGLSFSRGCSYTCAKKIQVPDCCPGFFGTLCEPCPGGLGGVCSGHGQCQDRFLGNGECRCQEGFHGTACEMCELGRYGPTCSGVCDCDHGLCQEGLRGNGSCVCHAGWQGLRCDQKITDHQCPKKCDPNANCIQDSAGIPACVCAAGYSGNGSYCSEVDPCASGHGGCSPYANCTKVAPGQRTCTCQDGYTGDGELCQEINSCLVHNGGCHVHAECIPTGPQQVSCSCREGYSGDGIQTCKLLDPCSQNNGGCSPYAVCKSTGDGQRTCSCDATHTVGDGITCHGRVGLELLRNKYASFFSLHLLEYKELKGDGPFTVFVPHADLISNMSQDELARIRAHRQLVFRYHVVGCRKLWSQEMLDQGYITTLSGHTLRVSEREGSIYLNDFARVVSSDLEVVNGVLHFIDHVLLPPDVLHWESGAIPIPQRNVTAAAESFGYKIFSRLLTVAGLLPMLQDASHRPFTMLWPTDSALQALPPDRKNWLFHEDHRDKLAAILRGHMIRNIEALASDLPNLGQLRTMHGNTISFSCGLTRPGELIVGEDEAHIVQRHLTFEGGLAYGIDQLLEPPDLGARCDRFEPQPLQMKTCSICGLEPPCPRGSREQGSPETCWRHYSKFWTTPLHSISMRGAYWIPSSFWNRNHMSRGCHRNCVTTVWKPSCCPGHYGINCHACPGGPRSPCSDHGVCLDGIRGSGQCNCHPGFAGTACELCAPGAFGPQCQACRCTQHGRCDEGLGGSGSCFCDEGWTGARCEVQLELQPVCTPPCAPQAVCRLGNSCECSLGYEGDGRVCTVADLCQKGHGGCSKHANCSQVGTVVTCTCLPDYEGDGWSCRARDPCLDGHRGGCSEHADCLNTGPNTRRCECHVGYVGDGLQCLEELEPPVDRCLGGSSPCHTDALCTDLHFQEKQAGVFHIQATSGPYGLTFSEAKEACEGQGAVLASLPQLSAAQQLGFHVCFVGWLANGSAAHPVVTPAADCGNNRVGVVSLGVRKNLSELWDAYCYRVQDVACQCRAGFVGDGISTCNGKLLDVLAATANFSTFYGMLLGYANATQRGLEFMDFLEDELTYKTLFVPVNKGFVDNMTLSGPDLELHASNATFLSINASRGTLLPAHSGLSLFISDTGPDNTSLVPLAPGAVVVSHVIVWDIMAFNGIIHALASPLLMPPQTRAVLGSEPPPVALSLGVVVTSGTLLGLVAGALYLRARGKPPGFSFSAFQAEDNADDDFSPWQEGTSPTLVSVPNPVFGSSDIFCEPFDDSVLEEDFPDTQRVLKVK

SEQ ID NO: 256 - protein, 2568 aa, Bos taurus
  Cow Stabilin-1  NP_001192499
MAGPRGHLLLCFLALCLAGPSFFGEQKVRSKRCDVKTKFVTHIPCTPCPAIKKRVCPLGWIRAFPEKISQDCRYEVQLGDSLLSMSGCSLECWKDMVQKACCPGYWGSQCYECPGGAETPCSGHGTCLDGLDGNGTCVCQENFSGSACQECRDPNRFGPDCQSVCRCVHGVCRHGPRGDGSCLCFAGYTGARCDQELLACQALNCPRNSQCSEEAPSCSCLPGYTQQGHECRASDPCRPSPCSPLAQCSVGPGGQAQCRCPENYHGDGTVCLPQDPCTTNNGGCPSNSTLCLYRKPGQASCLCKPGLVSIAHDSSAGCFAHCSAFSCDRSATCQVTPDGKTSCVCKEGEVGDGRACYGHLLHEVQKASQTSMLLRLRVTFAMLDQGCREILSTSGPFTVLAPLVSSRTMNASVAQQLCRQHIIAGQHMLEEAGTQAPRRWWTLAGQEITVSFSRFRKYTYKYQDQPQQTFTIHKANYPAANGLFHVVTALRLQPPPELPEDPKRTIGQILASNEVFSRFETILENCGLPSFLDGPGPFTVFAPSNEAVDGLRDGRLVYLFTAGLSKLQELVRYHVYNHGQLTVEKLLSKGRVLTMANQILAVNISEEGRILLGPEGVPLRRVDVLAANGVIHMLEGVLLPPTILPILPKLCNEEQHAVVAGSCVDCQALNTSTCPPNSVKLDISPEECVYIHDPTGLNVLKKGCAYYCNQTIQKPGCCKGFFGPDCLQCPGGFSNPCYGKGNCSDGVQGSGACLCFPDYKGIACHICSNPNKHGDQCQEDCGCVHGLCDNRPGSGGVCQHGTCAPGFSGRFCNESTVSCGSTEQAQQCHPHARCVNQGGVSRCLCLDGFEGDGFSCTPSDPCSRPDRGGCSENAECVPGVRGAHHCMCHKGWSGDGRVCVAVDECELDLRGGCHADALCSYVGPGQSRCTCKLGFAGDGYVCSPIDPCRAGNGGCHDLATCRAVGGGQRVCTCPPDYGGDGFSCYGDILKELEANAHFSVFYQWIKGAGITLPADSQVTALVPSESAIRRLSTEDQAFWLQPRLLPQLVRAHFLQGALSEEELARLHGQNVSTLNPTVRWEIHNVSGRVWVQNASVDVADLLATNGVLHVLSQVLLPPRRDVLGGQGLLQQLDSVPAFHLFRELLQRHRLVPQIEAATAYTIFVPTNHSLEAQANSSSLDSDVVRHHVILGEALSTEALGKGGHRNSLLGPAHWLVFYNHSGQPEVNHVPLEGPVLQAPGRSLFGLSGVLTVGSSRCLHSHAEALREKCVNCSRKFRCTQGYQLEDTPRKSCVYRSGYSFSRGCSYTCAKKIQVPDCCPGFFGTLCEPCPGGLGGVCSGHGQCQDRLLGSGECRCHEGFHGTACEMCELGRYGPNCTGVCDCAHGLCQEGLRGDGSCVCNVGWQGLRCDQKISGPQCLQKCDPNANCVQDSAAAPVCVCAAGYSGDGVSCSAVDPCARDHGGCSPHANCTTVAPGQRTCTCLDGYTGDGELCREANSCLIRHGGCHMHAECIPTGPQQVSCSCREGYSGDGIRACVLLDPCSQNNGGCSPYAVCKSTGDGQRTCACDAVRTVGDGFTCRARISLELLRDKHASFFSLHLLEYKDLKGDGPFTVFVPHADLLTNMSQDELARIRANRQLVFRYHVVGCRQLRSQELLEEGYATALSGHPLRFSEREGNIYINDFARVVSSDQEAVNGVLHFIDRVLLPPEVLHWEADAAPAPRRNFTAAAETFGYKIFSGLVTMAGLLPLLQDSSHRPLTMLWPTDSALQALPPDRQVWLYHKDHRDKLAAILRGHVIRNVEALASDLPNLGPLRTMHGTPISFSCSHARPGALTVGEDAARIVQRHLPFEGGLAYGIDQLLEPPGLGARCDRFETRPLWLKVCSICGLEPPCPPGSQEQGSPEACWRYFSKFWTSPPLHSLALRSVWTRPSHWGHPQGLGRGCYRNCVTTTWKPSCCPGHYGSECRACPGGASSPCNQRGSCMDGMSGSGECRCHTRFAGTACELCAPGAFGPLCQACNCTSHGRCDEGLGGSGSCFCDEGWTGPRCEVQLELQPVCAPPCAPQAVCRAGNSCECSLGYEGDGRTCTVVNLCQDGRGGCSEHANCSQAGTAVTCICWPDYEGDGWSCRARNPCEDGLRGGCSEHADCLNTGPNTRRCVCHAGYVGDGLQCLLEPEPPVDRCLDRPPPCHADAVCTDLHFQEKRAGVFHLQAPSGPYGLNFSEAEAACGAQGAVLASLLQLSAAQQLGLHLCLVGWLANGSAAHPVVFPAADCGDGQVGVVSLGARENLSERWDAYCFRMRDVACRCRDGFVGDGTSVCNGKLLDVLATTANFSIFYGMLLGYANATPRGLEFLDFLDDERTYKTLFVPVDEAFTDNTTLSGPDLELHASNTTFLSANASQGALLPAHSGLSLVIGNLGPGNSSRAPEVPGAVVVSRVIVWDILAFNGIIHTLASPLLAPPQAWAVVAPEAPPVAAGVGAVVAAGAVLGLVAGALYFRGRSRSAGFGFSAFQAEDAAADDFSPWQEGTSPPLVSVPNPVFGSHEAFCEPFDDSVLEEDFPDTQRILEVK

SEQ ID NO: 257 - protein, 2559 aa, Mus musculus
  Mouse Stabilin-2  Q8R4U0
MARSKLLLGKLLPLILIFLGLLVQNACSPTEAPELTKRCDKKSTLTIKTECQSCSVNIAVKCPDGYIKITNGTVGVRDCRYSLKIQSYVLDIPGCRHICRKDYLQPQCCPGHWGPDCMECPGGARAPCGGRGVCDEGMEGTGSCSCRAGFRGTACENCAAEDVFGPNCSAVCSCVHGVCNSGISGDGTCECLSAYRGPRCDKPIPECAALLCPENSRCSPSSKDETKLQCKCLPSYKGDGQTCKPINPCLKNVCHPHASCSYLGPNRHSCVCQKGYQGDGQVCLPVDPCQTSYGNCPTKSTVCRYDGPGQSHCECKEHYRNFVPGVGCSMTDICESKNPCHKNANCSTVSPGQTQCTCQKGYVGDGLNCYGNIMQRLRELNTEPRGMWQGQLTSFISILDRTYAWPLSNLGPFTVLLPSDKGLKGVDVKELLMDKEAARYFVKLHIIAGQMSTEQMYNLDTFYTLTGKSGEIINKDKDNQLKLKLYGSKIVQIIQGNIVASNGLVHILDRAMDKIEPTLESNPQQTIMTMLQPRYGKFRSLLEKTNVGQALEKGGIDEPYTIFVPSNEALSNMTAGVLDYLLSPEGSRKLLELVRYHIVAFTQLEVATLVSTLHIRSMANQIITFNISSKGQILANNVAVDETEVAAKNGRIYTLTGVLIPPSILPILPHRCNETKREMKLGTCVRCFMKNWSKCPTNSEPTAIFTNKCFYGSRAWNLKIGCARYCDVTVEIPRCCKGFFGPDCNPCPGGFMNPCSGNGQCIDGLGGNGTCICEDGFQGSRCQFCSKPNRYGPQCNRTCQCVHGICDNRLDSDGSCLPGTCREGTAGRFCDKQTSACGPYMQFCHIHATCEYSNETASCVCNDGYEGDGTLCSKKDPCLGSTSRGGCSPNAECIQASTGTYSCVCQRGWTGNGRDCVEINSCLLPSSGGCHDNATCLYVGPGQNECECKKGFRGNGIDCEPIISCLEQIEKCHPLATCQYTLSGVWSCVCQEGYEGNGVLCYGNVLMELSFLSEAAVFYQWINNASLQSMLSATSNLTVLVPSLQAIKDMDQNEKSFWLSRNNIPALIKYHTLLGTYRVADLQTLPSSHMLATSLQGSFLRLDKADGNITIEGASFVDGDNAATNGVVHIINKVLIPQRGLTGSLPSLLTRLEQMPDYSIFRGYIIHYNLASAIEAADAYTVFVPNNEAIESYIREKKATSLKEDILQYHVVLGEKLLRNDLHNGMHRETMLGFSYLLAFFLHNDQLYVNEAPINYTNVATDKGVIHGLEKVLEIKKNRCDNNDTIIVRGKCGKCSQQTLCPLETKPLSETRKCIYSVYFMGKRSIFIGCQLQCVRTIITSACCAGFFGPQCQACPGKGQNVCSGNGFCLDGVNGTGTCECEQGFNGTACETCTEGKYGIHCDQACSCVHGRCNQGPSGDGSCDCDVGWRGVKCDSEITTDNCNGTCHTSANCLLDPDGKASCKCAAGFQGNGTVCTAINACEISNGGCSAKADCKRTIPGSRVCVCKAGYTGDGIVCLEINPCLENHGGCDRHAECTQTGPNQAVCNCLPKYTGDGKVCTLINVCLTNNGGCSPFAFCNHTEQDQRTCTCKPDYTGDGIVCRGSIHSELPKNPSTSQYFFQLQEHAVQELAGPGPFTVFVPSSDSFNSESKLKVWDKQGLMSQILRYHVVACQQLLLENLKVITSATTLQGEPISISVSQDTVLINKKAKVLSSDIISTNGVIHVIDTLLSPQNLLITPKGASGRVLLNLTTVAANHGYTKFSKLIQDSGLLKVITDPMHTPVTLFWPTDKALQALPQEQQDFLFNEDNKDKLKAYLKFHVIRDTMALASDLPRSASWKTLQGSELSVRCGTGSDVGELFLNGQMCRIIQRRLLFDGGVAYGIDCLLMDPTEGGRCDTFTTFNIPGECGSCFSTPRCPLQSKPKGVRKKCIYNPLPFRRDVEGCQNLCTLVVHVPRCCSGYFMPDCQACPGGPDTPCNNRGMCYDQYKPTGQCQCHTGFNGTACELCLPGRFGPDCQPCGCSEHGQCDEGITGSGQCLCEAGWTGRFCDAPTVVIPVCIPACSMHATCMENNTCVCNLNYEGDGITCTVVDFCKQNNGGCAKVAKCSQKGTQVSCSCQKGYKGDGHSCTEIDPCANGVNGGCHEHATCRMTGPGKQKCECKSHYVGDGRDCEPEQLPLDRCLQDNGQCHPDANCVDLHFQDTTVGVFHLRSPLGQYKLTFDKAKEACAKEAASIATYNQLSYAQKAKYHLCSAGWLESGRVAYPTIYASKKCANIVGIVDYGTRTNKSEMWDVFCYRMKDVNCTCKAGYVGDGFSCNGNLLQVLMSFPSLTNFLTEVLVFSRSSAQGRAFLKHLTDLSISGTLFVPQNSGLPKNKSLSGRDIEHHLTNVNVSFYDDLVNGTVLKTRLGSQLLITSSQDQLHQEARFVDGRAILQWDIIASNGVLHIISEPLKAPPTAATAAHSGLGTGIFCAVVLVTGAIALAAYSYFRLNQRTTGFRRFESEDDIDALAFGKQQPESITNPLYETSTPAAPEPSCDPFTDSGERELENSDPLGALRS

SEQ ID NO: 258 - protein, 1431 aa, Rattus norvegicus
  Rat Stabilin-2  Q8CFM6
SLPSLLTRLEQMPDYSIFRGYIIHYNLASAIESADAYTVFVPNNEAIENYIREKKATSLKEDILRYHVVLGEKLLKNDLHNGMHRETMLGFSYLLAFFLRNDQLYVNEAPINYTNVATDKGVIHGLEKVLEIQKNRCDNNDTIIVRGECGKCSQQAPCPLETKPLRETRKCIYSIYFMGKRSVFIGCQPQCVRTIITRACCAGFFGPQCQACPGRGQNVCSGNGFCLDGVNGTGTCQCGLGFNGTACETCTEGKYGIHCDQACSCVHGRCSQGPLGDGSCDCDVGWRGVKCDMEITTDNCNGTCHTSANCLLDPDGKASCKCAAGFRGNGTVCTAINACETSNGGCSTKADCKRTTPGNRVCVCKAGYTGDGIVCLEINPCLENHGGCDRNAECTQTGPNQAVCNCLPKYTGDGKVCSLINVCLTNNGGCSPFAFCNYTEQDQRICTCKPDYTGDGIVCRGSIYGELPKNPSTSQYFFQLQEHAVRELAGPGPFTVFAPLSSSFNHEPRIKDWDQQGLMSQVLRYHVVGCQQLLLDNLKVTTSATTLQGEPVSISVSQDTVFINNEAKVLSSDIISTNGVIHVIDKLLSPKNLLITPKDALGRVLQNLTTVAANHGYTKFSKLIQDSGLLSVITDSIHTPVTVFWPTDKALEALPPEQQDFLFNQDNKDKLKSYLKFHVIRDSKALASDLPRSASWKTLQGSELSVRCGTGSDIGELFLNEQMCRFIHRGLLFDVGVAYGIDCLLMNPTLGGRCDTFTTFDIPGECGSCIFTPKCPLKSKPKGVKKKCIYNPLPFRRNVEGCQNLCTVVIQTPRCCHGYFMPDCQACPGGPDTPCNNRGMCRDLYTPMGQCLCHTGFNGTACELCWHGRFGPDCQPRSCSEHGQCDEGITGSGECLCETGWTAASCDTPTAVFAVCTPACSVHATCTENNTCVCNLNYEGDGITCTVVDFCKQNNGGCAKVAKCSQKGTQVSCSCKKGYKGDGYSCIEIDPCADGVNGGCHEHATCRMTGPGKHKCECKSHYVGDGVDCEPEQLPLDRCLQDNGQCHPDASCADLYFQDTTVGVFHLRSPLGQYKLTFDKAKEACAKEAATIATYNQLSYAQKAKYHLCSAGWLESGRVAYPTTYASQKCGANVVGIVDYGSRANKSEMWDVFCYRMKDVNCTCKAGYVGDGFSCSGNLLQVLMSFPSLTNFLTEVLAFSKSSARGQAFLKHLTDLSIRGTLFVPQNSGLPGNKSLSGRDIEHHLTNVNVSFYNDLVNGTFLRTMLGSQLLITFSQDQLHQETRFVDGRSILQWDIIAANGILHIISEPLRAPPTAATAAHSGLGTGIFCAVVLVTGAIALAAYSYFRLKQRTTGFQRFDQKRTLMSWLLASSSPRISQTLCMRPQRRHPQSPPVTPSQTLENRIWRTATLWGHCGPDMRSQQATTVTVPR

SEQ ID NO: 259 - protein, 778 aa, Mus musculus
  Mouse CD44  P15379
MDKFWWHTAWGLCLLQLSLAHQQIDLNVTCRYAGVFHVEKNGRYSISRTEAADLCQAFNSTLPTMDQMKLALSKGFETCRYGFIEGNVVIPRIHPNAICAANHTGVYILVTSNTSHYDTYCFNASAPPEEDCTSVTDLPNSFDGPVTITIVNRDGTRYSKKGEYRTHQEDIDASNIIDDDVSSGSTIEKSTPEGYILHTYLPTEQPTGDQDDSFFIRSTLATIASTVHSKSHAAAQKQNNWIWSWFGNSQSTTQTQEPTTSATTALMTTPETPPKRQEAQNWFSWLFQPSESKSHLHTTTKMPGTESNTNPTGWEPNEENEDETDTYPSFSGSGIDDDEDFISSTIATTPRVSARTEDNQDWTQWKPNHSNPEVLLQTTTRMADIDRISTSAHGENWTPEPQPPFNNHEYQDEEETPHATSTTPNSTAEAAATQQETWFQNGWQGKNPPTPSEDSHVTEGTTASAHNNHPSQRITTQSQEDVSWTDFFDPISHPMGQGHQTESKDTDSSHSTTLQPTAAPNTHLVEDLNRTGPLSVTTPQSHSQNFSTLHGEPEEDENYPTTSILPSSTKSSAKDARRGGSLPTDTTTSVEGYTFQYPDTMENGTLFPVTPAKTEVFGETEVTLATDSNVNVDGSLPGDRDSSKDSRGSSRTVTHGSELAGHSSANQDSGVTTTSGPMRRPQIPEWLIILASLLALALILAVCIAVNSRRRCGQKKKLVINGGNGTVEDRKPSELNGEASKSQEMVHLVNKEPSETPDQCMTADETRNLQSVDMKIGV

SEQ ID NO: 260 - protein, 503 aa, Rattus norvegicus
  Rat CD44  P26051
MDKVWWHTAWGLLCLLQLSLAQQQIDLNITCRYAGVFHVEKNGRYSISRTEAADLCEAFNTTLPTMAQMELALRKGFETCRYGFIEGHVVIPRIHPNAICAANNTGVYILLASNTSHYDTYCFNASAPLEEDCTSVTDLPNSFDGPVTITIVNRDGTRYSKKGEYRTHQEDIDASNIIDEDVSSGSTIEKSTPEGYILHTDLPTSQPTGDRDDAFFIGSTLATIATTPWVSAHTKQNQERTQWNPIHSNPEVLLQTTTRMTDIDRNSTSAHGENWTQEPQPPFNNHEYQDEEETPHATSTTWADPNSTTEEAATQKEKWFENEWQGKNPPTPSEDSHVTEGTTASAHNNHPSQRMTTQSQEDVSWTDFFDPISHPMGQGHQTESKGHSSGNQDSGVTTTSGPARRPQIPEWLIILASLLALALILAVCIAVNSRRRCGQKKKLVINSGNGTVEDRKPSELNGEASKSQEMVHLVNKEPTETPDQFMTADETRNLQSVDMKIGV

SEQ ID NO: 261 - protein, 366 aa, Bos taurus
  Cow CD44 Q29423
MDTFWWRAAWGLCLVQLSLAQIDLNITCRYAGVFHVEKNGRYSISKTEAADLCKAFNSTLPTMAQMEAARNIGFETCRYGFIEGHVVIPRIHPNSICAANNTGVYILTSNTSQYDTICFNASAPPGEDCTSVTDLPNAFEGPITITIVNRDGTRYTKKGEYRTNPEDINPSVVSPSSPPDDEMSSGSPSERSTSGGYSIFHTHLPTVHPSRPRRPWSQRAENTSDTRDYGSSHDPSGRSYTTHASESAGHSSGSEEHGANTTSGPMRKPQIPEWLIILASLLALALILAVCIAVNSRRRCGQKKKLVINNGNGTMEERKPSGLNGEASKSQEMVHLVNKGSSETPDQFMTADETRNLQNVDMKIGV

SEQ ID NO: 262 - protein, 351 aa, Canis lupus familiaris
  Dog CD44  Q28284
LAWGLCLLRLSLAQIDLNITCRYAGVFHVEKNGRYSISRTAAADLCKAFNSTLPTMAQMERALSVGFETCRYGFIEGHVVIPRIQPNAICAANHTGVYILISNTSQYDTYCFNASAPPEEDCTSVTHLPNAFDGPITITIVNRDGTRYSQKGEYRTNPEDINPSNPTDDDVSSGSSSERSTSAGYNIFHTHLPTAYPTEDQDSSRVSSNSDHTPITKDHDSSVHPSERSHTTHGSESAGHSSGSQEGGANTTSGPMRKPQIPEWLIILASLLALALILAVCIAVNSRRRCGQKKKLVINNGNGAVGDRKPSGINGEASKSQEMVHLVNKEPSETPDQYTTADETRNLQNVD

SEQ ID NO: 263 - protein, 359 aa, Equus caballus
  Horse CD44 Q05078
MDKFWWRAAWGLCLVPLSLAQIDLNITCRYAGVFHVEKNGRYSISRTEAADLCKAFNSTLPTMAQMQKALNIGFETCRIGFIEGHVVIPPIHPNSICAANNTGVYILTSNTSQYDTYCFNASAPPEEDCTSVTDLPNAFEGPITITIVNRDGTRYTKKGEYRTNPEDINPSTPADDDVSSGSSSERSTSGGYSIFHTHLPTTRPTQDQSSPWVSDSPEKTPTTKDRASGGRAQTTHGSETSGHSTGSQEGGASTTSGPIRRPQIPEWLIILASLLALALILAVCIAVNSRRRCGQKKKLVINNGNGAVDDRKASGLNGEASRSQEMVHLVNKESSETQDQFMTADETRNLQNVDMKIGV

SEQ ID NO: 264 - protein, 362 aa, Cricetulus griseus
  Hamster CD44  P20944
MDKFWWHAAWGLCLLPLSLAHEQIDLNITCRYAGVFHVEKNGRYSISRTEAADLCQAFNSTLPTMDQMVMALSKGFETCRYGFIEGHVVIPRIQPNAICAANHTGVYILTSNTSHYDTYCFNASAPLEEDCTSVTDLPNSFEGPVTITIVNRDGTRYSKKGEYRTHQEDIDASNTTDDDVSSGSSSEKSTSGGYVFHTYLPTIHSTADQDDPYFIGSTMATRDQDSSMDPRGNSLTVTDGSKLTEHSSGNQDSGLNSTSRPGGKPRVPEWLIVLASLLALALILAVCIAVNSRRRCGQKKKLVINSGNGKVEDRKPSELNGEASKSQEMVHLVNKEPSETPDQFMTADETRNLQNVDMKIGV

SEQ ID NO: 265 - protein, 362 aa, Papio hamadryas
  Baboon CD44 P14745
MDKFWWRAAWGLCLVQLSLAQIDLNITCRFEGIYHVEKNGRYSISRTEAADLCKAFNSTLPTMAQMEKALSIGFETCRYGFIEGHVVIPRIHPNSICAANNTGVYILTSNTSQYDTYCFNASAPPGEDCTSVTDLPNAFDGPITITIVNRDGTRYVKKGEYRTNPEDINPSSPTDDDVSSGSSSERSSTLGGYIFYNHFSTSPPIPDEDGPWITDSTDRTPATRDQGAFDPSGGSHTTHGSESAGHSHGSREGGANTTSGPLRTPQIPEWLIILASLLALALILAVCIAVNSRRRCGQKKKLVINNGNGAVEDRKSSGLNGEASKSQEMVHLVNKESSETPDQFMTADETRNLQNVDMKIGV

SEQ ID NO: 266 - protein, 431 aa, Mesocricetus auratus
  Golden Hamster CD44 Q60522
MDKFWWHAAWGLCLLPLSLAQQQIDLNITCRYAGVFHVEKNGRYSISRTEAADLCQAFNSTLPTMDQMVMALSKGFETCRYGFIEGHVVIPRIQPNAICAANHTGVYILTSNTSHYDTYCFNASAPLEEDCTSVTDLPNSFEGPVTITIVNRDGTRYSKKGEYRTHQEDIDASNTTDDDVSSGSSSEKSTSGGYVFHTYLPTIHSTADQDDPYFIGSTMATTRSGGKDGRRGGGLPKDATTSLEGYTTHYPETMENGTLTPVTPAKTGVFGETEVTVAEDSNFNVDGSLPGDQDSSMDPRGNSLTVTDGSKLTGHSSGNQDSGANTTSRPGRKPQIPEWLIVLASLLALALILAVCIAVNSRRRCGQKKKLVINSGNGKVEDRKPSELNGEASKSQEMVHLVNKEPSETPDQFMTADETRNLQNVDMKIGV

SEQ ID NO: 267 - protein, 318 aa, Mus musculus
  Mouse LYVE-1  Q8BHC0
MLQHTSLVLLLASIWTTRHPVQGADLVQDLSISTCRIMGVALVGRNKNPQMNFTEANEACKMLGLTLASRDQVESAQKSGFETCSYGWVGEQFSVIPRIFSNPRCGKNGKGVLIWNAPSSQKFKAYCHNSSDTWVNSCIPEIVTTFYPVLDTQTPATEFSVSSSAYLASSPDSTTPVSATTRAPPLTSMARKTKKICITEVYTEPITMATETEAFVASGAAFKNEAAGFGGVPTALLVLALLFFGAAAVLAVCYVKRYVKAFPFTTKNQQKEMIETKVVKEEKADDVNANEESKKTIKNPEEAKSPPKTTVRCLEAEV

SEQ ID NO: 268 - protein, 322 aa, Bos taurus
  Cow LYVE-1 Q6UC88
MAKFFSLGLLLASIWTTRLLVQGSLRSEEISILGPCRIMGVTLVTKKTQPLLNFTEAQEACRLVGLTLASQDQVEEARKFGFETCSYGWVKNQFVVIPRIISNPKCGKSGVGVVIWRSSLSSRHRSYCHNSSDIWINSCLPEIITTDDPLFNTETATYTTKLMVSDSTHSELSTDGPDYVTTTVAPPLASTSTPRKRKLICITEAFMDTSAVATERESDIQNRPAFKNEAVGFGGVPTALLVLALLFFAAAAGLAVCYVKRYVKAFPFTNKNQQKEMIETKVVKEEKADDSNPNEESKKMNKTPEEPKSPPKTTVRCLEAEV

SEQ ID NO: 269 - protein, 180 aa, Bos taurus
  Cow HAPLN1 A8E4P9
MKSLLLLVLISFCWADHHSDNYTVDHDRVIHIQAENGPRLLVEAEQAKVFSRRGGNVTLPCKFYRDPTAFGSGTHKIRIKWTKLTSDYLKEVDVFVSMGYHKKTYGGYHGRVFLKGGSDNDASLVITDLTLEDYGRYKCEVIEGLEDDTAVVALDLQGKYGVKLGMIINHCFFFMTSNVQ

SEQ ID NO: 270 - protein, 356 aa, Mus musculus
  MOUSE HAPLN1 Q9QUP5
MRSLLLLVLISVCWADHHLSDSYTPPDQDRVIHIQAENGPRLLVEAEQAKVFSHRGGNVTLPCKFYRDPTAFGSGIHKIRIKWTKLTSDYLREVDVFVSMGYHKKTYGGYQGRVFLKGGSDNDASLVITDLTLEDYGRYKCEVIEGLEDDTAVVALELQGVVFPYFPRLGRYNLNFHEARQACLDQDAVIASFDQLYDAWRGGLDWCNAGWLSDGSVQYPITKPREPCGGQNTVPGVRNYGFWDKDKSRYDVFCFTSNFNGRFYYLIHPTKLTYDEAVQACLNDGAQIAKVGQIFAAWKLLGYDRCDAGWLADGSVRYPISRPRRRCSPTEAAVRFVGFPDKKHKLYGVYCFRAYN

SEQ ID NO: 271 - protein, 354 aa, Rattus norvegicus
  RAT HAPLN1 P03994
MRSLLFLVLISVCRADHLSDSYTPDQDRVIHIQAENGPRLLVEAEQAKVFSHRGGNVTLPCKFYRDPTAFGSGIHKIRIKWTKLTSDYLREVDVFVSMGYHKKTYGGYQGRVFLKGGSDNDASLIITDLTLEDYGRYKCEVIEGLEDDTAVVALELQGVVFPYFPRLGRYNLNFHEARQACLDQDAVIASFDQLYDAWRGGLDWCNAGWLSDGSVQYPITKPREPCGGQNTVPGVRNYGFWDKDKSRYDVFCFTSNFNGRFYYLIHPTKLTYDEAVQACLNDGAQIAKVGQIFAAWKLLGYDRCDAGWLADGSVRYPISRPRRRCSPTEAAVRFVGFPDKKHKLYGVYCFRAYN

SEQ ID NO: 272 - protein, 355 aa, Gallus gallus
  CHICKEN HAPLN1 P07354
MTSLLFLVLISVCWAEPHPDNSSLEHERIIHIQEENGPRLLVVAEQAKIFSQRGGNVTLPCKFYHEHTSTAGSGTHKIRVKWTKLTSDYLKEVDVFVAMGHHRKSYGKYQGRVFLRESSENDASLIITNIMLEDYGRYKCEVIEGLEDDTAVVALNLEGVVFPYSPRLGRYNLNFHEAQQACLDQDSIIASFDQLYEAWRSGLDWCNAGWLSDGSVQYPITKPREPCGGKNTVPGVRNYGFWDKERSRYDVFCFTSNFNGRFYYLIHPTKLTYDEAVQACLKDGAQIAKVGQIFAAWKLLGYDRCDAGWLADGSVRYPISRPRKRCSPNEAAVRFVGFPDKKHKLYGVYCFRAYN

SEQ ID NO: 273 - protein, 354 aa, Bos taurus
  COW HAPLN1 P55252
MKSLLLLVLISFCWADHHSDNYTVDHDRVIHIQAENGPRLLVEAEQAKVFSRRGGNVTLPCKFYRDPTAFGSGTHKIRIKWTKLTSDYLKEVDVFVSMGYHKKTYGGYHGRVFLKGGSDNDASLVITDLTLEDYGRYKCEVIEGLEDDTAVVALDLQGVVFPYFPRLGRYNLNFHEAQQACLDQDAVIASFDQLYDAWRSGLDWCNAGWLSDGSVQYPITKPREPCGGQNTVPGVRNYGFWDKDKSRYDVFCFTSNFNGRFYYLIHPTKLTYDEAVQACLNDGAQIAKVGQIFAAWKLLGYDRCDAGWLADGSVRYPISRPRRRCSPSEAAVRFVGFPDKKHKLYGVYCFRAYN

SEQ ID NO: 274 - protein, 354 aa, Equus caballus
  HORSE HAPLN1 28381
MKSLLLLVLISICGADHRSDNYTLDHDRVIHIQAENGPRLLVEAEQAKVFSHRGGNVTLPCKFLRDPTAFGSGTHKIRIKWTKLTSDYLKEVDVFVSMGYHKKTYGGYQGRVFLKGGSDNDASLVITDLTLDDYGRYKCEVIEGLEDDTAVVALDLQGVVFPYFPRLGRYNLNFHEAQQACLDQDAVIASFDQLYDAWRGGLDWCNAGWLSDGSVQYPITKPREPCGGQNTVPGVRNYGFWDKEKSRYDVFCFTSNFNGRFYYLIHPTKLTYDEAVQACLKDGAQIAKVGQIFAAWKLLGYDRCDAGWLADGSVRYPISRPRRRCSPTEAAVRFVGFPDKKHKLYGVYCFRAYN

SEQ ID NO: 275 - protein, 354 aa, Sus scrofa
  PIG HAPLN1 P10859
MKSLLLLVLISVCWADHLSNNYTLDHDRVIHIQAENGPRLLVEAEQAKVFSHRGGNVTLPCKFFRDPTAFGSGTHKIRIKWTKLTSDYLKEVDVFVSMGYHKKTYGGYHGRVFLKGGSDNDASLVITDLTLEDYGRYKCEVIEGLEDDTAVVALDLEGVVFPYFPRLGRYNLNFHEAQQACLDQDAVIASFDQLYDAWRGGLDWCNAGWLSDGSVQYPITKPREPCGGQNTVPGVRNYGFWDKDKSRYDVFCFTSNFNGRFYYLIHPTKLTYDEAVQACLNDGAQIAKVGQIFAAWKLLGYDRCDAGWLADGSVRYPISRPRRRCRPNEAAVRFVGFPDKKHKLYGVYCFRAYN

SEQ ID NO: 276 - protein, 341 aa, Mus musculus
  Mouse HAPLN2 Q9ESM3
MPSRIPLPAFCCFLLPWAFTSFHKALGNPAPHPGPHYLLPPIHEVIHSRRGATATLPCVLGTSPPSYKVRWSKVEPGELRETLILITNGLHARDYGLLGGRASLRRGHRLDASLIIKNVRLEDEGRYRCELINGIEDESVALTLRLEGVVFPYQPSRGRYQFNYFEAKRACEEQDGRLATYGQLYQAWTEGLDWCNAGWLLEGSVRYPVLTARAPCGGHGRPGIRSYGPRDRSRDRYDAFCFTSALAGQVFFVPGRLTLSEAHAACRRRGAVVAKVGHLYAAWKFSGLDQCDGGWLADGSVRFPITTPRPRCGGLPDPGVRSFGFPRPQQASYGTYCYAEK

SEQ ID NO: 277 - protein, 341 aa, Rattus norvegicus
  Rat HAPLN2 Q9ESM2
MPSWIPLPAFCCLLLPWAFTVFHKTLGNPAPHPGPHYLLPPIHEVIHSRRGATATLPCVLGTSPPSYKVRWSKVEPGELRETLILITNGLHARDYGLLGGRASLRRGHRLDASLIIKNVRLEDEGRYRCELINGIEDESVALTLRLEGVVFPYQPSRGRYQFNYFEAKRACEEQDGRLATYSQLYQAWTEGLDWCNAGWLLEGSVRYPVLNARAPCGGHGRPGIRSYGPRDRSRDRYDAFCFTSALAGQVFFVPGRLTLSEAHAVCRRRGAVVAKVGHLYAAWKFSGLDRCDGGWLADGSVRFPITTPRPRCGGLPDPGVRSFGFPRPQQAAYGTYCYAEK

SEQ ID NO: 278 - protein, 340 aa, Bos taurus
  Cow HAPLN2 NP_001069152
MQGRISLPTLCHFLLPWAFTTFHRALGSQAPHPGPHYLLPPIHEVIHSRRGATTTLPCVLGAPPPSYKVRWSKVEPGELRETPILITNGLHARGYGPLGGRARMRRGHRLDASLVIAGVRLEDEGRYRCELINGIEDESVAMTLRLEGVVFPYQPSRGRYQFNYYEAKQACEEQDGRLATYAQLYQAWTEGLDWCNAGWLLEGSVRYPVLTARAPCGGRGRPGIRSYGPRDRKRDRYDAFCFTSALSGHVFFVPGRLSLSEAHAACRRRGAMVAKVGHLYAAWKFSGLDQCDGGWLADGSVRFPITTPRPRCGGLPDPGVRSFGFPRPQQADYGTYCYSE

SEQ ID NO: 279 - protein, 359 aa, Mus musculus
  Mouse HAPLN3 Q80WM5
MSLLFLVLLSPFPCVLGLPFYNGFYYSNDLSGRTLGNGYGEGLFNGVKLVVETTEESLFSHQGASVTLPCHYHYEPALASPRHVRVKWWKLSENGAPEQDVLVVIGQRHRSFGDYQGRVQLRQDKQQEVSLELRDLRLEDSGRYRCEVIDGLEDESGLVELELRGVVFPYQSREGRYQLNFHEAQQACQEQGAMVATFEQLFRAWEEGLDWCNAGWLQDASVQYPIVLPRQPCGGLGLAPGVRSYGQRHHRLHRYDVFCFAAALKGRVYYLENPKKLTLLEAREACQEDGAQISTVGQLFAAWKFRGLDRCDAGWLADGSARYPIVHPRLNCGPPEPGVRTFGFPDPHTRYGVYCYVQH

SEQ ID NO: 280 - protein, 359 aa, Rattus norvegicus
  Rat HAPLN3 NP_001008559
MGLLFLVLLSPLSCVLGLPFYNGFYYSNGLHGRTLGNGYGEGLFNGVKLVVETTEESLFSHQGASVTLPCHYHYEPALASPRHVRIKWWKLSENGTPEQDVLVAIGQRHRSFGDYQGRVQLRQDKEQEVSLELRDLRLEDSGRYRCEVIDGLEDESGLVELELRGVVFPYQPREGRYQLNFHEAQQVCQEQDAVVATFEQLFRAWEEGLDWCNAGWLQDASVQYPIVLPRQPCGGLGLAPGVRSYGQRHHRLHRYDVFCFAAALKGRVYYLENPEKLTLLEAREACQEDGAQISTVGQLFAAWKFRGLDRCDAGWLADGSARYPIIHPRPNCGPPEPGVRTFGFPDPNTRYGVYCYHQH

SEQ ID NO: 281 - protein, 360 aa, Bos taurus
  Cow HAPLN3 NP_001092451.1
MGLRLPILLLLLCCVSGLPFYNGFYYSNRPNGRNLGNSYSEGIFNGVKLVVETPEETLFSHRGANVTLPCRYHYEPALASPRPVRIKWWKLSENGVPEQDVLVAIGLRQRTFGDYRGRVRLRQDRAREVSLEIRDLRLEDYGRYRCEVIDGLEDESGLVELELRGVVFPYQHPQGRYKFNFHEAQQACEEQDAVVASFEQLFRAWEEGLDWCNAGWLQDASVQYPVTQARRPCGGLGLAPGVRSYGPRHRRLHRYDVFCFAVALRGQVYYLEHPEKLTLAEAREACQEDGAQIAKVGQLFAAWKFRGLDRCDAGWLADGSARYPVAHPRSNCGALEPGVRSFGFPDPHSRQYGVYCYRPR

SEQ ID NO: 282 - protein, 402 aa, Mus musculus; identical to SEQ ID NO: 232
  Mouse HAPLN4 Q80WM4

SEQ ID NO: 283 - protein, 421 aa, Bos taurus
  Cow HAPLN4 KIAA1926 DAA28318
MRERSPSAWGPLGEGRTGRMVCARAALGPGALWAAAWGVLLLTAAAEAQRGRKKVVHVLEGESGSVVVQTAPGQVVSHRGGTIVLPCRYHYEAATHGHDGVRLKWTKVVDPLAFADVFVALGPQHRAFGSYRGRAELQGDGPGDASLVLRNVTLQDYGRYECEVTNELEDDTGMVKLDLEGVVFPYHPRGGRYKLTFAEAQRACAEQDGILASAEQLHAAWRDGLDWCNAGWLRDGSVQYPVSQPREPCGGLGGAGSAGAGGGASGGVRNYGYRHNAEERYDAFCFTSNLPGRVFFLKPLRPVPFSGAARACAARGAAVAKVGQLFAAWKLQLLDRCTAGWLADGSARYPIVNPRARCGGRRPGVRSLGFPDASRRLFGVYCYRAPGAPDPAPGGWGWGWAGGGGWAGGSRDPAAWTPLRV

SEQ ID NO: 284 - protein, 400 aa, Rattus norvegicus
  Rat HAPLN4 NP_001101868
MACAPGALGHRALWAVAWGLLLLVPVLAGAQRGRKKVVHVLEGESGSVVVQTAPGQVVSHRGGTIVLPCRYHYEAAAHGHDGVRLKWTKVVDPLAFADVFVALGPQHRAFGPYRGRAELQNDGPGDASLVLRNVTLQDYGRYECEVTNELEDDAGMVKLDLEGVVFPYHPRGGRYKMTFAEAQRACAEQDGILASAEQLHTAWRDGLDWCNAGWLRDGSVQYPVSQAREACGGSGSPGAGGGTNGGVRNYGYRHNAEERYDAFCFTSNLPGRVFFLKPLRPVALAGAVRACAARGATVAKVGQLFAAWKLQLLDRCTAGWLADGSARYPIVNPRTRCGGPRPGVRSLGFPDASRRLFGVYCYRAPGAPDPAPGGWGWGWAGGGGWAGGSRDPAAWTPLRV

SEQ ID NO: 285 - protein, 537 aa, Sus scrofa
  Pig Aggrecan Q29011
  VARIANT 45, 49, 146: Xaa = any amino acid
AISVEVSEPDNSLSVSIPQPSPLRVLLGGSLTIPCYFIDPMHPVXTAPXTAPLAPRIKWSRVSKEKEVVLLVATEGQVRVNSAYQDRVTLPNYPAIPSDATLEIQNLRSNDSGIYRCEVMHGIEDSEATLEVVVKGIVFHYRAISXRYTLDFDRAQRACLQNSAIIATPEQLQAAYEDGFHQCDAGWLADQTVRYPIHTPREGCYGDKDEFPGVITYGIRDTNETYDVYCFAEEMEGEVFYATSPEKFTFQEAANECRRLGARLATTGQLYLAWRGGMDMCSAGWLADRSVRYPISKARPNCGGNLLGVRTVYLHANQTGYPDPSSRYDAICYTGEDFVDIPENFFGVGGEEDITIQTVTWPDVELPLPRNITEGEARGTVILTVKPVFEFSPTAPEPEEPFTFAPGTGATAFPEAENRTGEATRPWAFPEESTPGLGAPTAFTSEDLVVQVTSAATEEGTEGPSATEAPSTSEEPFPSEKPFPSEEPFPSEEPFPSEKPSASEEPFPSEQPSTLSAPVPSRTELPGSGEVSGAPEV

SEQ ID NO: 286 - protein, 2109 aa, Gallus gallus
  CHICKEN AGGRECAN P07898
MTTLLLVFVCLQAITTAASAELSDSSDGLEVKIPEQSPLRVVLGSSLNIPCYFNIPEEEDTNALLTPRIKWSKLSNGTEIVLLVATGGKIRLNAEYREVISLPNYPAIPTDATLEIKALRSNHTGIYRCEVMYGIEDRQDTIEVLVKGVVFHYRAISTRYTLNFERAKQACIQNSAVIATPEQLQAAYEDGYEQCDAGWLADQTVRYPIHLPRERCYGDKDEFPGVRTYGVRETDETYDVYCYAEQMQGKVFYATSPEKFTFQEAFDKCHSLGARLATTGELYLAWKDGMDMCSAGWLADRSVRYPISRARPNCGGNLVGVRTVYLNPANQTGYPHPSSRYDAICYSGDDFEALVPGLFTDEVGTELGSAFTIQTVTQTEVELPLPRNVTEEEARGSIATLEPMEITATATELYEAFTVLPDLFATSVTVETASPREENVTREEITGIWAVPEEVTTSVSGTAFTTGMAEVSSVEEAIAVTATPGLESASPFTIEDHLVQVTAAPDVALLPRQPISPTGVVFHYRAATSRYAFSFIQAQQACLENNAVIATPEQLQAAYEAGFDQCDAGWLRDQTVRYPIVNPRSNCVGDKESSPGVRSYGMRPASETYDVYCYIDRLKGEVFFATQPEQFTFQEAQLYCESQNATLASAGQLHAAWKQGLDRCYPGWLADGSLRYPIVSPRPACGGDAPGVRTIYQHHNQTGFPDPLSRHHAFCFRALPSVVEEGVTSLFEEEVMVTQLIPGVEGIPSGEETTVETELSSEPENQTAQGTEVFPTDVSLLSARPSAFPPATVIPEETSTNASIPEVSGEFPESGEHPTSGEPSASGAPDTSGEPTSVGFELSGEQSGIGESGLPSVDLQSSGFVPGESGLPSGDVSGLPSGIVDISGLPSAEEEVTVSVSRIPEVSGMPSGAESSGLHSGFSGEISGTELISGLPSGEESGLASGFPTISLVDSTLVEVVTAAPGRQEEGKGSIGVSGEEELSGFPSAEWDSSGARGLPSGAETSGEQSGVPELSGEHSGVPGLSGEAFEVPELSGEHSGVTELSGEHSGLPELSGEPFGVPELSGFPSGLDISGEPSGAPEVSGPVDVSGLTSGVDGSGEVSGVTFISTSLQEVTTPSVAEAEAKEILEISGLPSGETSGMVSGSLDVSGQPSGHIGFGGSASGVLEMSGFPGGAVESSGEASGVEVTSGLASGEESGLTSGFPTVSLVDTTLVEVVTQTSVAQEVGEGPSGMIEISGFLSGDRGVSGEGSGAVQSSGLPSGTGDFSGEPSGIPYFSGDISGATDLSGQPSAVTDISGEDSGLPEVTLVTSDLVEVVTRPTVSQELGGETAVTFPYVFGPSGEGSASGDLSGGASAEGGIETSTAYEISGESSAFPETSIETSTDQEISGEASAYPEISVETSTHLETSGETSAYPEISTETSTIQEVSGETSAFPEISTETSTIQEISGETSAFPEIRIETSTFQEISGETSAFPEIRIETSTSQEARGETSAFPEITIEASTVHETSGETSAFPEISIETSTVHETSGETSAFPEISIETSTVHEISGESSAFPEIRIETSTSQEARGETSAFPEITIEASTIQEISGETSAFPEISIETSTVREISGETSAFPEIRIETSTSQEARGETSALPEITIETSTVHETSGEASAFPEISIETSTRQEARSEASAYPEVSIEASTTQEVSGESSAFPEISVETSTSQEARGETSAFPEIGIETSTAHEGSGETPGLPAVSTDTAATSLASGEPSGAPEKETPDTTSHLITGVSGETSVPDAVISTSAPDVELAQEPRNTEETQLEIEPSTPAASGQETETAAVLDNPHLPATATAALHPASQEAVDALGPTTEDTDECHSSPCLNGATCVDGIDSFKCLCLPSYGGDLCEIDLANCEEGWIKFQGHCYRHFEERETWMDAESRCREHQAHLSSIITPEEQEFVNSHAQDYQWIGLSDRAVENDFRWSDGHSLQFENWRPNQPDNFFFAGEDCVVMIWHEQGEWNDVPCNYHLPFTCKKGTVACGDPPVVENARTFGRKKDRYEINSLVRYQCDHGYIQRHVPTIRCQPNGHWEEPRISCTNPSSYQRRLYKRSPRSRLRPGVVHRPTH

SEQ ID NO: 287 - protein, 2132 aa, Mus musculus
  MOUSE AGGRECAN Q61282
MTTLLLVFVTLRVIAAVISEEVPDHDNSLSVSIPQPSPLKVLLGSSLTIPCYFIDPMHPVTTAPSTAPLTPRIKWSRVSKEKEVVLLVATEGQVRVNSIYQDKVSLPNYPAIPSDATLEIQNLRSNDSGIYRCEVMHGIEDSEATLEVIVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQGGMDMCSAGWLADRSVRYPISKARPNCGGNLLGVRTVYLHANQTGYPDPSSRYDAICYTGEDFVDIPENFFGVGGEDDITIQTVTWPDLELPLPRNVTEGEALGSVILTAKPIFDLSPTISEPGEALTLAPEVGSTAFPEAEERTGEATRPWGFPAEVTRGPDSATAFASEDLVVRVTISPGAAEVPGQPRLPGGVVFHYRPGSTRYSLTFEEAQQACMHTGAVIASPEQLQAAYEAGYEQCDAGWLQDQTVRYPIVSPRTPCVGDKDSSPGVRTYGVRPSSETYDVYCYVDKLEGEVFFATRLEQFTFQEARAFCAAQNATLASTGQLYAAWSQGLDKCYAGWLADGTLRYPIITPRPACGGDKPGVRTVYLYPNQTGLPDPLSKHHAFCFRGVSVAPSPGEEGGSTPTSPSDIEDWIVTQVGPGVDAVPLEPKTTEVPYFTTEPRKQTEWEPAYTPVGTSPQPGIPPTWLPTLPAAEEHTESPSASEEPSASAVPSTSEEPYTSSFAVPSMTELPGSGEASGAPDLSGDFTGSGDASGRLDSSGQPSGGIESGLPSGDLDSSGLSPTVSSGLPVESGSASGDGEVPWSHTPTVGRLPSGGESPEGSASASGTGDLSGLPSGGEITETSTSGAEETSGLPSGGDGLETSTSGVDDVSGIPTGREGLETSASGVEDLSGLPSGEEGSETSTSGIEDISVLPTGGESLETSASGVGDLSGLPSGGESLETSASGAEDVTQLPTERGGLETSASGVEDITVLPTGRESLETSASGVEDVSGLPSGREGLETSASGIEDISVFPTEAEGLDTSASGGYVSGIPSGGDGTETSASGVEDVSGLPSGGEGLETSASGVEDLGPSTRDSLETSASGVDVTGFPSGRGDPETSVSGVGDDFSGLPSGKEGLETSASGAEDLSGLPSGKEDLVGSASGALDFGKLPPGTLGSGQTPEVNGFPSGFSGEYSGADIGSGPSSGLPDFSGLPSGFPTVSLVDSTLVEVITATTSSELEGRGTIGISGSGEVSGLPLGELDSSADISGLPSGTELSGQASGSPDSSGETSGFFDVSGQPFGSSGVSEETSGIPEISGQPSGTPDTTATSGVTELNELSSGQPDVSGDGSGILFGSGQSSGITSVSGETSGISDLSGQPSGFPVFSGTATRTPDLASGTISGSGESSGITFVDTSFVEVTPTTFREEEGLGSVELSGFPSGETELSGTSGTVDVSEQSSGAIDSSGLTSPTPEFSGLPSGVAEVSGEFSGVETGSSLPSGAFDGSGLVSGFPTVSLVDRTLVESITQAPTAQEAGEGPSGILEFSGAHSGTPDISGELSGSLDLSTLQSGQMETSTETPSSPYFSGDFSSTTDVSGESIAATTGSGESSGLPEVTLNTSELVEGVTEPTVSQELGHGPSMTYTPRLFEASGDASASGDLGGAVTNFPGSGIEASVPEASSDLSAYPEAGVGVSAAPEASSKLSEFPDLHGITSAFHETDLEMTTPSTEVNSNPWTFQEGTREGSAAPEVSGESSTTSDIDTGTSGVPSATPMASGDRTEISGEWSDHTSEVNVAISSTITESEWAQPTRYPTETLQEIESPNPSYSGEETQTAETTMSLTDAPTLSSSEGSGETESTVADQEQCEEGWTKFQGHCYRHFHDRETWVDAERRCREQQSHLSSIVTPEEQEFVNKNAQDYQWIGLNDRTIEGDFRWSDGHSLQFEKWRPNQPDNFFATGEDCVVMIWHERGEWNDVPCNYQLPFTCKKGTVACGDPPVVEHARTLGQKKDRYEISSLVRYQCTEGFVQRHVPTIRCQPSGHWEEPRITCTDPNTYKHRLQKRSMRPTRRSRPSMAH

SEQ ID NO: 288 - protein, 2364 aa, Bos taurus
  COW AGGRECAN P13608
MTTLLLVFVTLRVITAAISVEVSEPDNSLSVSIPEPSPLRVLLGSSLTIPCYFIDPMHPVTTAPSTAPLAPRIKWSRISKEKEVVLLVATEGRVRVNSAYQDKVTLPNYPAIPSDATLEIQNMRSNDSGILRCEVMHGIEDSQATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQGGMDMCSAGWLADRSVRYPISKARPNCGGNLLGVRTVYLHANQTGYPDPSSRYDAICYTGEDFVDIPESFFGVGGEEDITIQTVTWPDVELPLPRNITEGEARGSVILTAKPDFEVSPTAPEPEEPFTFVPEVRATAFPEVENRTEEATRPWAFPRESTPGLGAPTAFTSEDLVVQVTLAPGAAEVPGQPRLPGGVVFHYRPGSSRYSLTFEEAKQACLRTGAIIASPEQLQAAYEAGYEQCDAGWLQDQTVRYPIVSPRTPCVGDKDSSPGVRTYGVRPPSETYDVYCYVDRLEGEVFFATRLEQFTFWEAQEFCESQNATLATTGQLYAAWSRGLDKCYAGWLADGSLRYPIVTPRPACGGDKPGVRTVYLYPNQTGLLDPLSRHHAFCFRGVSAAPSPEEEEGSAPTAGPDVEEWMVTQVGPGVAAVPIGEETTAIPGFTVEPENKTEWELAYTPAGTLPLPGIPPTWPPTGEATEEHTEGPSATEVPSASEKPFPSEEPFPPEEPFPSEKPFPPEELFPSEKPFPSEKPFPSEEPFPSEKPFPPEELFPSEKPIPSEEPFPSEEPFPSEKPFPPEEPFPSEKPIPSEEPFPSEKPFPSEEPFPSEEPSTLSAPVPSRTELPSSGEVSGVPEISGDFTGSGEISGHLDFSGQPSGESASGLPSEDLDSSGLTSTVGSGLPVESGLPSGEEERITWTSAPKVDRLPSGGEGPEVSGVEDISGLPSGGEVHLEISASGVEDISGLPSGGEVHLEISASGVEDLSRIPSGEGPEISASGVEDISGLPSGEEGHLEISASGVEDLSGIPSGEGPEVSASGVEDLIGLPSGEGPEVSASGVEDLSRLPSGEGPEVSASGVEDLSGLPSGEGPEVSVSGVEDLSRLPSGEGPEVSASGVEDLSRLPSGEGPEISVSGVEDISILPSGEGPEVSASGVEDLSVLPSGEGHLEISTSGVEDLSVLPSGEGHLETSSGVEDISRLPSGEGPEVSASGVEDLSVLPSGEDHLEISASGVEDLGVLPSGEDHLEISASGVEDISRLPSGEGPEVSASGVEDLSVLPSGEGHLEISASGVEDLSRLPSGGEDHLETSASGVGDLSGLPSGREGLEISASGAGDLSGLTSGKEDLTGSASGALDLGRIPSVTLGSGQAPEASGLPSGFSGEYSGVDLESGPSSGLPDFSGLPSGFPTVSLVDTTLVEVVTATTAGELEGRGTIDISGAGETSGLPFSELDISGGASGLSSGAELSGQASGSPDISGETSGLFGVSGQPSGFPDISGETSGLLEVSGQPSGFYGEISGVTELSGLASGQPEISGEASGILSGLGPPFGITDLSGEAPGIPDLSGQPSGLPEFSGTASGIPDLVSSAVSGSGESSGITFVDTSLVEVTPTTFKEEEGLGSVELSGLPSGELGVSGTSGLADVSGLSSGAIDSSGFTSQPPEFSGLPSGVTEVSGEASGAESGSSLPSGAYDSSGLPSGFPTVSFVDRTLVESVTQAPTAQEAGEGPSGILELSGAPSGAPDMSGDHLGSLDQSGLQSGLVEPSGEPASTPYFSGDFSGTTDVSGESSAATSTSGEASGLPEVTLITSELVEGVTEPTVSQELGQRPPVTYTPQLFESSGEASASGDVPRFPGSGVEVSSVPESSGETSAYPEAEVGASAAPEASGGASGSPNLSETTSTFHEADLEGTSGLGVSGSPSAFPEGPTEGLATPEVSGESTTAFDVSVEASGSPSATPLASGDRTDTSGDLSGHTSGLDIVISTTIPESEWTQQTQRPAEARLEIESSSPVHSGEESQTADTATSPTDASIPASAGGTDDSEATTTDIDECLSSPCLNGATCVDAIDSFTCLCLPSYQGDVCEIQKLCEEGWTKFQGHCYRHFPDRATWVDAESQCRKQQSHLSSIVTPEEQEFVNNNAQDYQWIGLNDKTIEGDFRWSDGHSLQFENWRPNQPDNFFATGEDCVVMIWHEKGEWNDVPCNYQLPFTCKKGTVACGEPPVVEHARIFGQKKDRYEINALVRYQCTEGFIQGHVPTIRCQPSGHWEEPRITCTDPATYKRRLQKRSSRPLRRSHPSTAH

SEQ ID NO: 289 - protein, 2333 aa, Canis familiaris
  DOG AGGRECAN Q28343
MTTLLWVFVTLRVITAASSEETSDHDNSLSVSIPEPSPMRVLLGSSLTIPCYFIDPMHPVTTAPSTAPLAPRIKWSRITKEKEVVLLVATEGQVRINSAYQDKVSLPNYPAIPSDATLEIQNLRSNDSGIYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVLYATSPEKFTFQEAANECRRLGARLATTGQLYLAWQGGMDMCSAGWLADRSVRYPISKARPNCGGNLLGVRTVYLHANQTGYPDPSSRYDAICYTGEDFVDIPENFFGVGGEEDITIQTVTWPDVELPLPRNITEGEARGNVILTVKPIFDLSPTAPEPEEPFTFVPEPEKPFTFATDVGVTAFPEAENRTGEATRPWGVPEESTPGPAFTAFTSEDHVVQVTAVPGAAEVPGQPRLPGGVVFHYRPGSARYSLTFEEAQQACLRTGAVIASPEQLQAAYEAGYEQCDAGWLQDQTVRYPIVSPRTPCVGDKDSSPGVRTYGVRPPSETYDVYCYVDKLEGEVFFITRLEQFTFQEALAFCESHNATLASTGQLYAAWRQGLDKCYAGWLSDGSLRYPIVTPRPSCGGDKPGVRTVYLYPNQTGLPDPLSRHHVFCFRGVSGVPSPGEEEGGTPTPSVVEDWIPTQVGPVVPSVPMGEETTAILDFTIEPENQTEWEPAYSPAGTSPLPGIPPTWPPTSTATEESTEGPSGTEVPSVSEEPSPSEEPFPWEELSTLSPPGPSGTELPGSGEASGVPEVSGDFTGSGEVSGHPDSSGQLSGESASGLPSEDLDSSGLTSAVGSGLASGDEDRITLSSIPKVEGEGLETSASGVEDLSGLPSGREGLETSTSGVGDLSGLPSGEGLEVSASGVEDLSGLPSGEGPETSTSGVGDLSRLPSGEGPEVSASGVGDLSGLPSGREGLETSTSGVEDLSGLPSGEGPEASTSGVGDLSRLPSGEGPEVSASGVEDLSGLPSGEGLEASASGVGDLSGLPSGEGPEASASGVGDLSRLPSGEGPEVSASGVEDLSGLSSGESPEASASGVGDLSGLPSGREGLETSASGVGDLSGLPSGEGQEASASGVEDLSRLPSGEGPEASASGVGELSGLPSGREGLETSASGVGDLSGLPSGEGPEAFASGVEDLSILPSGEGPEASASGVGDLSGLPSGREGLETSTSGVGDLSGLPSGREGLETSTSGVGDLSGLPSGEGPEASASGIGDISGLPSGREGLETSSSGVEDHPETSASGVEDLSGLPSGVEGHPETSASGVEDLSDLSSGGEGLETSASGAEDLSGFPSGKEDLIGSASGALDFGRIPSGTLGSGQAPEASSLPSGFSGEYSGVDFGSGPISGLPDFSGLPSGFPTISLVDTTLVEVITTTSASELEGRGTIGISGAGETSGLPVSELDISGAVSGLPSGAELSGQASGSPDMSGETSGFFGVSGQPSGFPDISGGTSGLFEVSGQPSGFSGETSGVTELSGLYSGQPDVSGEASGVPSGSGQPFGMTDLSGETSGVPDISGQPSGLPEFSGTTSGIPDLVSSTMSGSGESSGITFVDTSLVEVTPTTFKEKKRLGSVELSGLPSGEVDLSGASGTMDISGQSSGATDSSGLTSHLPKFSGLPSGAAEVSGESSGAEVGSSLPSGTYEGSGNFHPAFPTVFLVDRTLVESVTQAPTAQEAGEGPSGILELSGAHSGAPDVSGDHSGSLDLSGMQSGLVEPSGEPSSTPYFSGDFSGTMDVTGEPSTAMSASGEASGLLEVTLITSEFVEGVTEPTVSQELAQRPPVTHTPQLFESSGEASASGEISGATPAFPGSGLEASSVPESSSETSDFPERAVGVSAAPEASGGASGAPDVSEATSTFPEADVEGASGLGVSGGTSAFPEAPREGSATPEVQEEPTTSYDVGREALGWPSATPTASGDRIEVSGDLSGHTSGLDVVISTSVPESEWIQQTQRPAEAHLEIEASSPLHSGEETQTAETATSPTDDASIPTSPSGTDESAPAIPDIDECLSSPCLNGATCVDAIDSFTCLCLPSYRGDLCEIDQELCEEGWTKFQGHCYRYFPDRESWVDAESRCRAQQSHLSSIVTPEEQEFVNNNAQDYQWIGLNDRTIEGDFRWSDGHSLQFENWRPNQPDNFFVSGEDCVVMIWHEKGEWNDVPCNYYLPFTCKKGTVACGDPPVVEHARTFGQKKDRYEINSLVRYQCTEGFVQRHVPTIRCQPSGHWEKPRITCTDPSTYKRRLQKRSSRAPRRSRPSTAH

SEQ ID NO: 290 - protein, 2124 aa, Rattus norvegicus
  RAT AGGRECAN P07897
MTTLLLVFVTLRVIAAVISEEVPDHDNSLSVSIPQPSPLKALLGTSLTIPCYFIDPMHPVTTAPSTAPLTPRIKWSRVSKEKEVVLLVATEGQVRVNSIYQDKVSLPNYPAIPSDATLEIQNLRSNDSGIYRCEVMHGIEDSEATLEVIVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRTVGARLATTGQLYLAWQGGMDMCSAGWLADRSVRYPISKARPNCGGNLLGVRTVYLHANQTGYPDPSSRYDAICYTGEDFVDIPENFFGVGGEEDITIQTVTWPDLELPLPRNITEGEARGNVILTAKPIFDMSPTVSEPGEALTLAPEVGTTVFPEAGERTEKTTRPWGFPEEATRGPDSATAFASEDLVVRVTISPGAVEVPGQPRLPGGVVFHYRPGSTRYSLTFEEAQQACIRTGAAIASPEQLQAAYEAGYEQCDAGWLQDQTVRYPIVSPRTPCVGDKDSSPGVRTYGVRPSSETYDVYCYVDKLEGEVFFATQMEQFTFQEAQAFCAAQNATLASTGQLYAAWSQGLDKCYAGWLADGTLRYPIVNPRPACGGDKPGVRTVYLYPNQTGLPDPLSKHHAFCFRGVSVVPSPGGTPTSPSDIEDWIVTRVEPGVDAVPLEPETTEVPYFTTEPEKQTEWEPAYTPVGTSPLPGIPPTWLPTVPAAEEHTESPSASQEPSASQVPSTSEEPYTPSLAVPSGTELPSSGDTSGAPDLSGDFTGSTDTSGRLDSSGEPSGGSESGLPSGDLDSSGLGPTVSSGLPVESGSASGDGEIPWSSTPTVDRLPSGGESLEGSASASGTGDLSGLPSGGEITETSASGTEEISGLPSGGDDLETSTSGIDGASVLPTGRGGLETSASGVEDLSGLPSGEEGSETSTSGIEDISVLPTGESPETSASGVGDLSGLPSGGESLETSASGVEDVTQLPTERGGLETSASGIEDITVLPTGRENLETSASGVEDVSGLPSGKEGLETSASGIEDISVFPTEAEGLETSASGGYVSGIPSGEDGTETSTSGVEGVSGLPSGGEGLETSASGVEDLGLPTRDSLETSASGVDVTGYPSGREDTETSVPGVGDDLSGLPSGQEGLETSASGAEDLGGLPSGKEDLVGSASGALDFGKLPSGTLGSGQTPEASGLPSGFSGEYSGVDIGSGPSSGLPDFSGLPSGFPTVSLVDSTLVEVITATTASELEGRGTISVSGSGEESGPPLSELDSSADISGLPSGTELSGQTSGSLDVSGETSGFFDVSGQPFGSSGTGEGTSGIPEVSGQAVRSPDTTEISELSGLSSGQPDVSGEGSGILFGSGQSSGITSVSGETSGISDLSGQPSGFPVLSGTTPGTPDLASGAMSGSGDSSGITFVDTSLIEVTPTTFREEEGLGSVELSGLPSGETDLSGTSGMVDVSGQSSGAIDSSGLISPTPEFSGLPSGVAEVSGEVSGVETGSSLSSGAFDGSGLVSGFPTVSLVDRTLVESITLAPTAQEAGEGPSSILEFSGAHSGTPDISGDLSGSLDQSTWQPGWTEASTEPPSSPYFSGDFSSTTDASGESITAPTGSGETSGLPEVTLITSELVEGVTEPTVSQELGHGPSMTYTPRLFEASGEASASGDLGGPVTIFPGSGVEASVPEGSSDPSAYPEAGVGVSAAPEASSQLSEFPDLHGITSASRETDLEMTTPGTEVSSNPWTFQEGTREGSAAPEVSGESSTTSDIDAGTSGVPFATPMTSGDRTEISGEWSDHTSEVNVTVSTTVPESRWAQSTQHPTETLQEIGSPNPSYSGEETQTAETAKSLTDTPTLASPEGSGETESTAADQEQCEEGWTKFQGHCYRHFPDRETWVDAERRCREQQSHLSSIVTPEEQEFVNKNAQDYQWIGLNDRTIEGDFRWSDGHSLQFEKWRPNQPDNFFATGEDCVVMIWHERGEWNDVPCNYQLPFTCKKGTVACGEPPAVEHARTLGQKKDRYEISSLVRYQCTEGFVQRHVPTIRCQPSADWEEPRITCTDPNTYKHRLQKRTMRPTRRSRPSMAH

SEQ ID NO: 291 - protein, 394 aa, Oryctolagus cuniculus
  RABBIT AGGRECAN Q28670
  VARIANT 289: Xaa = any amino acid
STAPLTPRIKWSRISKDKEVVLLVANEGRVRINSAYQDKVSLPNYPAIPSDATLEIQSLRSNDSGIYRCEVMHGLEDSEATLEVVVKGVVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAASECRRLGARLATTGQLYLAWQAGMDMCSAGWLADRSVRYPISKARPNCGGNLLGVRTVYVHANQTGYPDPSSRYDAICYTGEXFMDIPENFFGVGGEEDITVQTVTWPDVELPVPRNITEGEARGSVVLTAKPVLDVSPTAPQPEETFAPGLGATAFPGVENGTEEATRPRGFADEAALGPSSATAFT

SEQ ID NO: 292 - protein, 883 aa, Rattus norvegicus
  RAT BREVICAN P55068
MIPLLLSLLAALVLTQAPAALADDLKEDSSEDRAFRVRIGAAQLRGVLGGALAIPCHVHHLRPPPSRRAAPGFPRVKWTFLSGDREVEVLVARGLRVKVNEAYRFRVALPAYPASLTDVSLVLSELRPNDSGVYRCEVQHGIDDSSDAVEVKVKGVVFLYREGSARYAFSFAGAQEACARIGARIATPEQLYAAYLGGYEQCDAGWLSDQTVRYPIQNPREACYGDMDGYPGVRNYGVVGPDDLYDVYCYAEDLNGELFLGAPPGKLTWEEARDYCLERGAQIASTGQLYAAWNGGLDRCSPGWLADGSVRYPIITPSQRCGGGLPGVKTLFLFPNQTGFPSKQNRFNVYCFRDSAHPSAFSEASSPASDGLEAIVTVTEKLEELQLPQEAVESESRGAIYSIPITEDGGGGSSTPEDPAEAPRTPLESETQSVAPPTGSSEEEGEALEEEERFKDTETPKEEKEQENLWVWPTELSSPLPTGLETEHSLSQVSPPAQAVLQVGASPSPRPPRVHGPTVETLQPPGEGSLTSTPDGAREVGGETGSPELSGVPREREEAGSSSLEDGPSLLPETWAPVGTREVETPSEEKSGRTVLTGTSVQAQPVLPTDSASRGGVAVAPSSGDCIPSPCHNGGTCLEEKEGFRCLCVPGYGGDLCDVGLHFCSPGWEPFQGACYKHFSTRRSWEEAESQCRALGAHLTSICTPEEQDFVNDRYREYQWIGLNDRTIEGDFLWSDGPPLLYENWNPGQPDSYFLSGENCVVMVWHDQGQWSDVPCNYHLSYTCKMGLVSCGPPPQLPLAQIFGRPRLRYAVDTVLRYRCRDGLAQRNLPLIRCQENGLWEAPQISCVPRRPARALRSMTAPEGPRGQLPRQRKALLTPPSSL

SEQ ID NO: 293 - protein, 883 aa, Mus musculus
  MOUSE BREVICAN Q61361
MIPLLLSLLAALVLTQAPAALADDLKEDSSEDRAFRVRIGATQLRGVLGGALAIPCHVHHLRPPHSRRAAPGFPRVKWTFLSGDREVEVLVARGLRVKVNEAYRFRVALPAYPASLTDVSLVLSELRPNDSGVYRCEVQHGIDDSSDAVEVKVKGVVFLYREGSARYAFSFAGAQEACARIGARIATPEQLYAAYLGGYEQCDAGWLSDQTVRYPIQNPREACSGDMDGYPGVRNYGVVGPDDLYDVYCYAEDLNGELFLGAPPSKLTWEEARDYCLERGAQIASTGQLYAAWNGGLDRCSPGWLADGSVRYPIITPSQRCGGGLPGVKTLFLFPNQTGFPSKQNRFNVYCFRDSAHPSASSEASSPASDGLEAIVTVTEKLEELQLPQEAMESESRGAIYSIPISEDGGGGSSTPEDPAEAPRTPLESETQSIAPPTESSEEEGVALEEEERFKDLEALEEEKEQEDLWVWPRELSSPLPTGSETEHSLSQVSPPAQAVLQLGASPSPGPPRVRGPPAETLLPPREGSPTSTPGGAREVGGETGSPELSGVPRESEEAGSSSLEDGPSLLPATWAPVGPRELETPSEEKSGRTVLAGTSVQAQPVLPTDSASHGGVAVAPSSGDCIPSPCHNGGTCLEEKEGFRCLCLPGYGGDLCDVGLHFCSPGWEAFQGACYKHFSTRRSWEEAESQCRALGAHLTSICTPEEQDFVNDRYREYQWIGLNDRTIEGDFLWSDGAPLLYENWNPGQPDSYFLSGENCVVMVWHDQGQWSDVPCNYHLSYTCKMGLVSCGPPPQLPLAQIFGRPRLRYAVDTVLRYRCRDGLAQRNLPLIRCQENGLWEAPQISCVPRRPGRALRSMDAPEGPRGQLSRHRKAPLTPPSSL

SEQ ID NO: 294 - protein, 912 aa, Bos taurus
  COW BREVICAN Q28062
MAPLFLPLLATLVLAWIPVALADALEGDSSEDRAFRVRIAGDAPLQGVLGGALTIPCHVHYLRPSPSRRAAQGSPRVKWTFLSGGREAEVLVARGLRVKVSEAYRFRVALPAYPASLTDVSLVLSELRPNDSGIYRCEVQHGIDDSSDAVEVKVKGVVFLYREGSARYAFSFAGAQEACARIGARIATPEQLYAAYLGGYEQCDAGWLSDQTVRYPIQTPREACYGDMDGFPGVRNYGVVDPDDLYDVYCYAEELNGELFLGAPPDKLTLEEARTYCQERGAKIATTGQLYAAWDGGLDRCSSGWLSDGSVRYPIVTPSQRCGGGLPGVKTLFLFPNQTGFPNKHSRFNVYCFRDSAQPSAIPEAANPASHLASDALEAIVTVTETLEELKLPQEAVESESRGAIYSIPIIEDGGGGSSTPEDPAEAPRTLLEFETQSIVPPLGSSEEEGKVLEQEEKYRGEEEKEEEEEEEEVEDEALWAWPSELSSLDPEAPLPTEPVPEESLTQASPPVRAALQPGVSPPPYDEPEAPRPPRVLGPPTKTLPTPREGNLASPPPSTLVGAREIEEETGGPELSGAPRGESEETGSSEDAPSLLPATRAPGDTRDLETPSEENSRRTVPAGTSVRAQPVLPTDSASRGGVAVAPSSGDCVPSPCHNGGTCLEEEEGVRCLCLPGYGGDLCDVGLHFCSPGWDAFQGACYKHFSARRSWEEAENKCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAEVFGRPRLRYEVDTVLRYRCREGLTQRNLPLIRCQENGRWGLPQISCVPRRPARALRPVEAQEGRPWRLVGHWKARLNPSPNPAPGP

SEQ ID NO: 295 - protein, 417 aa, Felis catus
  CAT BREVICAN P41725
  VARIANT 367: Xaa = any amino acid
MAPLFLPLLIALALAPGPTASADVLEGDSSEDRAFRVRISGNAPLQGVLGGALTISCHVHYLRPPPGRRAVLGSPRVKWTFLSGGREAEVLVARGLRVKVSEAYRFRVALPAYPASLTDVSLALSELRPNDSGIYRCEVQHGIDDSSDAVEVKVKGVVFLYREGSARYAFSFARAQEACARIGARIATPEQLYAAYLGGYEQCDAGWLSDQTVRYPIQTPREACYGDMDGFPGVRNYGLVDPDDLYDIYCYAEDLNGELFLGAPPDNVTLEEATAYCRERGAEIATTGQLYAAWDGGLDRCSPGWLADGSVRYPIVTPSQRCGGGLPGVKTLFLFPNQTGFPNKYSRFNVYCFRDSGQPSTTPEASXPASDGLEAIVTVTETLEELHVPREAVESESRGAIYSVPIVEDGGGARSPP

SEQ ID NO: 296 - protein, 3357 aa, Mus musculus
  MOUSE VERSICAN Q62059
MLINMKGILWMCSTLLLTHALHQAKMETSPPVKGSLSGKVVLPCHFSTLPTLPPNYNTSEFLRIKWSKMEVDKNGKDIKETTVLVAQNGNIKIGQDYKGRVSVPTHPDDVGDASLTMVKLRASDAAVYRCDVMYGIEDTQDTMSLAVDGVVFHYRAATSRYTLNFAAAQQACLDIGAVIASPEQLFAAYEDGFEQCDAGWLSDQTVRYPIRAPREGCYGDMMGKEGVRTYGFRSPQETYDVYCYVDHLDGDVFHITAPSKFTFEEAEAECTSRDARLATVGELQAAWRNGFDQCDYGWLSDASVRHPVTVARAQCGGGLLGVRTLYRFENQTCFPLPDSRFDAYCFKPKQNISEATTIEMNILAETSSPSLSKEPHMVPDRATPVIPLATELPIFTTHFPPAGNIVNSEQKSVVYSQAITGRLATESPTTTRNTINSWDLNDSLASGSGPLGMPDISEIKEEELRSTTVISQHATGSQAVITEDTQTHESVSQIEQIEVGPLVTSMEITNHISLKELPEKNKTPYESTEVTLEHTTEMPTVSASPELATTSHYGFTLREDDREDRTLTVRSDQSTRVFSQIPEVITVSKTSEDTTYSQLGDLESISTSTITMLGTDRSLIDKEKEPKTNGKVTEDEFGQSQPTTTFPSQHLTEVELLPYSGDTTSVEGISTVIYPSLQTDVTQGRERTETPRPELKKDPYTVDEIPEKVTKDPFIGKTEEVFSGMPLSTSSSESSVERTESVSPALTIEKLTGKPTEARDVEEMTTLTRLETDVTKSDKDVTRVHLTHSTLNVEVVTVSKWPGDEDNSTSKPLPSTEHAGFTKLPPVPLSTIGINGKDKEIPSFTDGGGEYTLFPDGTPKPLEKVSEEDLASGELTVTFHTSTSIGSAEKSASGEPTTGDRFLPTTSTEDQVINATAEGSALGEDTEASKPLFTGPPFVHTSDVEELAFVNYSSTQEPTTYVDISHTSPLSIIPKTEWSVLETSVPLEDEILGKSDQDILEQTHLEATMSPGALRTTGVSQGETQEEPQTPGSPFPTFSSTAVMAKETTAFEEGEGSTYTPSEGRLMTGSERVPGLETTPVGTSYPPGAITDQEVEMDTMVTLMSTIRPTVVSSTESEVIYEAEGSSPTEFASTLRPFQTHVTQLMEETTEEGKKASLDYTDLGSGLFEPRATELPKFPSTPSDISVFTAIDSLHRTPPLSPSSSFTEEQRVFEEESSEKTTGDILPGESVTQHPVTTLIDIVAMKTESDIDHMTSKPPVTQPTRPSVVERKTTSKTQELSTSTPAAGTKFHPDINVYIIEVRENKTGRLSDMIVSGHPIDSESKEEEPCSEETDPLHDLFAEILPELPDSFEIDIYHSEEDEDGEEDCVNATDVTTTPSVQYINGKQLVTTVPKDPEAAEARRGQYESVAPSQNFPDSSATDTHQFILAETESSTTMQFKKSKEGTELLEITWKPETYPETPDHVSSGEPDVFPTLSSHDGKTTRWSESITESSPNLENPVHKQPKPVPLFPEESSGEGAIEQASQETILSRATEVALGKETDQSPTLSTSSILSSSVSVNVLEEEPLTLTGISQTDESMSTIESWVEITPSQTVKFSESSSAPIIEGSGEVEENKNKIFNMVTDLPQRDPTDTLSPLDMSKIMITNHHIYIPATIAPLDSKLPSPDARPTTVWNSNSTSEWVSDKSFEGRKKKENEDEEGAVNAAHQGEVRAATERSDHLLLTPELESSNVDASSDLATWEGFILETTPTESEKEMANSTPVFRETIGVANVEAQPFEHSSSSHPRVQEELTTLSGNPPSLFTDLGSGDASTGMELITASLFTLDLESETKVKKELPSTPSPSVEISSSFEPTGLTPSTVLDIEIAGVMSQTSQKTLISEISGKPTSQSGVRDLYTGFPMGEDFSGDFSEYPTVSYPTMKEETVGMGGSDDERVRDTQTSSSIPTTSDNIYPVPDSKGPDSTVASTTAFPWEEVMSSAEGSGEQLASVRSSVGPVLPLAVDIFSGTESPYFDEEFEEVAAVTEANERPTVLPTAASGNTVDLTENGYIEVNSTMSLDFPQTMEPSKLWSKPEVNLDKQEIGRETVTKEKAQGQKTFESLHSSFAPEQTILETQSLIETEFQTSDYSMLTTLKTYITNKEVEEEGMSIAHMSTPGPGIKDLESYTTHPEAPGKSHSFSATALVTESGAARSVLMDSSTQEEESIKLFQKGVKLTNKESNADLSFSGLGSGGALPPLPTTSVNLTDMKQIISTLYAETSHMESLGTSILGDKMEDHERMEDVSSNEVRMLISKIGSISQDSTEALDTTLSHTGTEEPTTSTLPFVKLMDLERSPKQDPSGGKRKPKTHRPQTMSGLISNENSSASEAEEGATSPTAFLPQTYSVEMTKHFAPSESQPSDLFNVNSGEGSGEVDTLDLVYTSGTTQASSQGDSMLASHGFLEKHPEVSKTEAGATDVSPTASAMFLHHSEYKSSLYPTSTLPSTEPYKSPSEGIEDGLQDNIQFEGSTLKPSRRKTTESIIIDLDKEDSKDLGLTITESAIVKSLPELTSDKNIIIDIDHTKPVYEYIPGIQTDLDPEIKLESHGSSEESLQVQEKYEGAVTLSPTEESFEGSGDALLAGYTQAIYNESVTPNDGKQAEDISFSFATGIPVSSTETELHTFFPTASTLHIPSKLTTASPEIDKPNIEAISLDDIFESSTLSDGQAIADQSEVISTLGHLEKTQEEYEEKKYGGPSFQPEFFSGVGEVLTDPPAYVSIGSTYLIAQTLTELPNVVRPSDSTHYTEATPEVSSLAELSPQIPSSPFPVYVDNGVSKFPEVPHTSAQPVSTVTSSQKSIESPFKEVHANIEETIKPLGGNVHRTEPPSMSRDPALDVSEDESKHKLLEELETSPTKPETSQDFPNKAKDHIPGETVGMLAGIRTTESEPVITADDMELGGATQQPHSASAAFRVETGMVPQPIQQEPERPTFPSLEINHETHTSLFGESILATSEKQVSQKILDNSNQATVSSTLDLHTAHALSPFSILDNSNETAFLIGISEESVEGTAVYLPGPDLCKTNPCLNGGTCYPTETSYVCTCAPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSALQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAMPKITCMNPSAYQRTYSKKYLKNSSSAKDNSINTSKHEHRWSRRQETRR

SEQ ID NO: 297 - protein, 2738 aa, Rattus norvegicus
  RAT VERSICAN Q9ERB4
MLINMNGILWMCSTLLLTHALHKAKMEENPPVKGSLSGKVILPCHFSTLPTLPPDYNTSEFLRIKWSKIEVDKNGKDIKETTVLVAQDGNIKIGQDYKGRVSVPTHPDDVGDASLTMVKLRASDAGVYRCDVMYGIEDTQNTMSLAVDGVVFHYRAATSRYTLNFESAQQACLDIGAVIATPEQLFAAYEDGFEQCDAGWLSDQTVRYPIRAPREGCYGDMMGKEGVRTYGFRSPQETYDVYCYVDHLDGDVFHITAPSKFTFEEAEAECANRDARLATVGELHAAWRNGFDQCDYGWLSDASVRHPVTVARAQCGGGLLGVRTLYRFENQTCFPLPDSRFDAYCFKRSPLSIIPKTEWSVSETSVPLEDEVLGKSDQDTLEQTHLEATMSPEALSTIEVTQGETQEEPQTPGIPFPALSSTAVMTKETTAFEEEGEGSTYTLSEDRLMTDSEIVPSLETTPVGTSYPGGAMTQQEVEMDTMVTQMSSIRPTVVLSTEPEVSYEAEGSSPMEFASTLKPFGTQVTQLVEETTEEGKKTPLDYTDLGSGLFEQPRVTELPDFSMTPSDISVFTAIDSLHRTTPLRPPSPFTEEPHIFEKEPSEKTTGDIILPRESVTQHPLTTLMDIIAKKTESDIDHEYHMTSKPPVMQPTRPSVVERKTTSKPQELSTSPPPAGTKFHPDINVYIIEVRENKTGRMSDMVVNGHPIDSESKEEEPCSEETDPLHDLFAEILPELPDSFEIDIYHSEEDEDGEEDCVNATDVTTTPSVQYITGKPHVTTVPKNPEAAEARRGLYESVAPSQNFSNTSATDTHQFIPAETELSTTMQFTKSKEATELLEITWKPETYPETPEHFSSGEPDVFPTLPSHDGKTTKWSEFITESNPNTENPEHKQPKPIPLFPEEFSGEGAIDQASQQTIFSRATEVALGKETDQSPTISTSSIRSGSVSVHALEEDPIALTGISQTDESMSTVESWVEMTPSQTVEFSGSSSAPTIEGSGEVEEYTNKIFNTVTDLPQREPTDTLIPLDMSNIMITDHHIYTPATTAPLDSQLPSTDARPTQFGIQTTTSEWVSSTSFEGRKTEEDKERDTNAAHTGEVQPATERSDRLLLTSELESSNVAASSPLDTWEGFVPETTSTVSEKEMANTTPVFTETSDVANLETQSFEHSSSSQPRVQEELTTLSGKPPLIFMDLGSGDASTDMEFITASSFTLDLESDTKVKKELPSTLSPSVETSSSSEPIGLAPSTVLDIEIVEVMNQTSKKTLISELSGKPTSQAEVRDLYPGLGEDFSGDSSEYPTVSSTTMKEETVGMGGSENERVKDTQTLSSIPPTSDNINPVPDSKGFGSTVASTTAFPWEEFMTSAEGSGEELSSVRSSVSLVLPLGVDILPTTESPYFDQEFEEAAAVTEAGKQSALPIAVSGNTVDLTENRDIEVNSTMSVDLPQTMEPAKLWSKPEVNPEKQEIGSETVTQDKAQGQKSFESLHSSLAPEQTTLESQSLIETEVQTSYYSMLTTMKTYNTNEEVEEEGTSIAHMSTPGPGIKGLESYPTHPEATGKSYSFSASALVTESGPARSVVMDSSTQEEESIKLFQKDMILTHKESNSDLSFSGLGSGEALPPLPTTSVSLTDMGKINSTLYPETSHMESLGTSILGDNHERMKNVSNEVRTLISETGSISQDSTEAPNTTLSDTRTEESTTSPLPFMKLMDTEHSPKQTLRWEEEIQTHRPQTMTGQMTNDNSSVSEAEAAATSAPAFLPETYSVEMTKAFATSPSQTSDLFDANSGEGSGEVDGLDLVYTSRTTQASSQGDSMFASHGFIEKHPEVSRTETGATDGSPTASAMFLHQSEYNESSLYPTSTLPSTVTYESPSEGIADGLQDHIRFEVSTLKPSRRKATESVIIDLDKEDSKDLGLAITESAIVEILPELTSDRNIIIDIDHTKPVYEYIPGIQTDLDSDIPLGSHGSSEESLEVQEKYEATINLSPTEEAFDGSGDALPAGHTQAIYNESVTPSDGKQPEDISFSFATGIPVSSTETELNTFFPTVSTLHIPSKLTTASPEIDKPNIEAISLDDIFESSTLSDGQAIADQSEVISTLGHLEKTQEEYEEKKYGGPSFQPEFFSGVGEVFTDAPAYVSIGRTYSVAQPLTEFPNVVGQSDSTHYTEATSAVSSVTELSPQTPSSPSPVYIDSGVSEFTEVPHKSAQPAPTAASSQKLIEGSFKKVRANIEATIKSLGENDHGTESPSMSPSPALDISEDDSKPKLLEDLETSPTKTETSQDSPNKANDQIPGKTAGILAGIKTTESGPVVTAADDMELGDATQRPHSASAPAAFRVETSMVPQPIPQEPERPTFPSLEINHETHTSLFEESILATSEKQVSQRILDYSNQATVSTLDLNTEHSIPPFSILDNSNETAFLIGISEETVEGTAVYLPGPDLCKTNPCLNGGTCYPTETSYVCTCAPGYSGDQCELDFDECHSNPCRNGATCVDGLNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSALQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAMPKITCMNPSAYQRTYSKKYLKNSSSVKDNSINTSKHEHRWSRRWQETRR

SEQ ID NO: 298 - protein, 862 aa, Macaca nemestrina
  PIG-TAILED MACAQUE VERSICAN Q28858
YPIRAPRVGCYGDMMGKAGVRTYGFRSPQETYDVYCYVDHLDGDVFHLTAPSKFTFEEAAKECENQDARLATVGELQAAWRNGFDQCDYGWLSDASVRHPVTVARAQCGGGLLGVRTLYRFENQTGFPPPDSRFDAYCFKRRMSDLSVIGHPIDSESKEDEPCSEETDPVHDLMAEILPEFPDIIEIDLYHSEENEEEEEECANATDVTTTPSVQYINGKHLVTTVPKDPEAASGTISTNFPQTMEPAKLWSRQEVNPERQEIESETTSEEQIQEEKSFESPQNSPATEQTIFDSQTFTETELKTTGYSVLTTKKTYSDDKEMEEEGTSLANMSTPVPDANGVESFTTLPEATEKSHFFLATALVTESIPAEHVVTDSPIKEEESTKHFPKGMRPTIQELDTELLFSGLGSGEEVLPTLPTKSVNFTEVEQIRNTFYPHTSQVESTSSDKLEDFNRMENVAKEVGPLGSQTDIFEGNESVTSTTLIEILSDPGAEGPTVAPLPFFANIGHPQNQTLRWAEEIQTSKLEPSEEDGKPELLEETEASPTEFIAVEGTEILQDFQNKTDGQVSGEAIKMFPTIKTPEAGTVITTANEIKLEGATQWPHSTSASATYGIEAGVMPWLSPQTSERPTLSSSPEINPETQAALIRGQDSTVAASEQQVTARILDTNDQATVSPVEFNTEVATPPFSLLETSNETDFLIGINEESVEGTAIYLPGPDRCKMNPCLNGGTCYPTETSYVCTCVPGYSGDQCELDFDECHSNPCRNGATCADGFNTFRCLCLPSYVGALCEQDIETCDYGWHKFQGQCYKYFAHRRTWDAAERECRLQGAHLTSILSHEEQMFVNRVGHDYQWIGLNDKMF

SEQ ID NO: 299 - protein, 3381 aa, Bos taurus
  COW VERSICAN P81282
MLINIKSILWMCSTLIAAHALQKVNMEKSPPVKGSLSGKVNLPCHFSTMPTLPPSYNTTSEFLRIKWSKIELDKTGKDLKETTVLVAQNGNIKIGQDYKGRVSVPTHPEDVGDASLTMVKLLASDAGRYRCDVMYGIEDTQDTVSLTVEGVVFHYRAATSRYTLNFEMAQKACVDIGAVIATPEQLHAAYEDGFEQCDAGWLSDQTVRYPIRVPREGCYGDMMGKEGVRTYGFRAPHETYDVYCYVDHLDGDVFHITAPNKFTFEEAGEECKTQDARLATVGELQAAWRNGFDRCDYGWLLDASVRHPVTVARAQCGGGLLGVRTLYRFENQTGFPTPDSRFDAYCFKPKQNISEATTIELNMLAETVSPTLLEELQVGLDRMTPIVPLITELPVITTKVPPIGNIVNFEQKSTVQPLTSTHRSATESLPPDGSMKKPWDMDYYSPSASGPLGEPDVSEIKEEVPQSTTVVSHHAPDSWDGVKEDLQIKDSVTQIEQIEVGPLVTSMEISKHIPSKEFTVTVTPFVSTTMTLESKTEKKAISTVSESVTTSHYGFTLREGDGEDRISTVRSGQSTSIFSQIPEVITVSKTSEDTTRGQLEDVESVSASTIVSPDSDGSPMDHRQEKQTHGRITEGFLGQYVSTTPFPSQHHTEVELFPYSGDKRLVEGTSTVISPTPRTGRERTETLRPAMRTVTYTNDEIQEKITKDSSIEKIEEEGFSGMKFPTASPEQIHHTKYSVGMTKSFESPALMTTTKPGVTPTEATDVEEDFTTPSGLETDGYQDTTEYEEGITTVHLIQSTLNVEVVTVSKWSLDEDNTTSKPLGSTEHVGSPKLPPALITTTGVSGKDKEMPSLTEDGRDEFTRIPGSTQRPLEEFTEEDTTDHEKFTVRFQPTTSIATTEKSTLRDSITEERVPPFTSTEVRVTHATIEGSALDEGEDVDVSKPLSTVPQFAHPSDVEGSTFVNYSSTQEPTTYVDTSHTIPLPVIPKTEWGVLVPSIPSEGEVLGEPSQDIRVINQTHFEASMYPETVRTTTEITQEATREDFLWKEQTPEKPVSPPSSTTDTAKETTPPLDEQESDGSAYTVFEDRSVMGSDRVSVLVTTPIGKFEQHTSFPPGAVTKAKTDEVVTLTPTTGSKVTFSPWPKQKYETEGTSPRGFVSPFSIGVTQLIEETTTEKREKTSLDYIDLGSGLFEKPKATELPEFSTVKATVPSDTAAFSSADRLHTPSASTEKPPLIDREPDEETTSDMVIIGESTSRVPPTTLEDIVAKKTETDIDREYFTTSSTSTTQPTRPPTVEGKEAFGPQAFSTPEPPAGTKFHPDINVYIIEVRENKTGRMSDFSVSGHPIDSESKEDEPCSEETDPEHDLIAEILPELLGMLHSEEDEEDEECANATDVTTTPSVQYINGKHVVTTVPKDPEAAEARRGQFESVAPSQNFSDSSESDSHQFIITHAGLPTAMQPNESKETTESLEITWRPEIYPETAEPFSSGEPDIFPTASIHEGEATEGPDSITEKNPELDHLVHEHAESVPLFPEESSGDAAIDQESQKIIFSGATEGTFGEEAEKSSTTHTPSMVASSVSAPVSEDASFILTGTPQSDEPLSTVESWVEITPRHTVEFSGSPSIPIPEGSGEAEEDKDKIFAMITDLSQRNTTDPRVTSDTSKIMITESLVDVPTTTIYSISEQVSAVVPTKFVRETDTYEWVFSPPLEETTRKEEEKGTTGTASTVEVHSPTQRLDQFVSPSELESSSETPPDDSAAATRKSFTSQMTPTQSERETTSSTVVFKETEVLDNLAAQTTDPSLSSQPGVLEVSPTVPGSPVSLFMEQGSGEAAVDPETTTVSSLSLNIEPEILAKEEAAGAWSPNVETVFPFEPTEQVLSTAVDREVAETISQTSKENLVSEISGEPTHRAEIKGFSTDFPLEEDFSGDFREYSTVSYPITKEEIVMMEGSGDAAFKDTQMLPSVTPTSDLSNHTADSEEPGSTLVSTSAFPWEEFTASAEGSGEPLLSVSSSVDQVFPSAAGKASGTDSPFIDQRLGEEGAINETDQRSTILPTAEAESTKASTEEGEVKENHTVSMDFPPTVEPDELWPRQEVNPVRQGNGSEIVSEEKTQEQESFEPLQSSVAPEQTTFDSQTFPEPGLQTTGYFTLTTKKTYSTDERMEEEVISLADVSTPTLDSKGLVLYTTLPEVTEKSHFFLATASVTESVPAESVIAGSTIKEEESIKPFPKVTSPIIKESDTDLIFSGLGSGEEVLPTLGSVNFTEIEQVLSTLYPLTSQVQSLEASILNDTSGDYEGMENVANEMRPLISKTDSIFEDGETASSTTLPEILSDARTEGPFTAPLTFSTGPGQPQNQTHRRAEEIQTSRPQPLTDQVSSENSVTAETKETATPATDFLARTYDLEMAKGFVTPTPKPSDLFYEHSGEGSGELDAVGAEVHASGMTQATRQGSTTFVSDRSLEKHPKVPSVEAVTVNGFPTVSMVLPLHPEQREGSPEATGTPASTASYEKATEGAADSFQDHFWGFKDSTLKPDKRKATESIIIDLDKEDKDLILTMTESTILEIIPELTSDKNTVIDIDHTKPIYEDILGMQTDLDPEVPSGPPDSSEESTQVQEKYEAAVNLSSTEENFEASGDILLANYTQATPESKAPEDRNPLDHTDFIFTTGIPILSSETELDVLLPTATSLPIPSKSATVNPESKTEAKTLEDIFESSTLSDGQAIADQSEVISTLGYLERTQNEDEAKKYVSPSFQPEFSSGAEEALTDPTPYVSIGTTYLTAQSLTEAPDVMEGARLPDSIDTSTVSAFSELLSQTPSFPPLSIHLGSGDSEHSEDLQPSALPSTDASTPPVSSGELANIEATFKPSSEEDFYITEPPSLPPDTEPSEDESKPKLLEPTEASATELIAQEEIEIFQNSDNTTSVQVSGEAVKVFPSIETPEAEAIVTAASETKLEGATLRPHSTSASVIHGVEAGVVPQPSPQTSERPTILSPLEISPETQAALIRGEDSTVAAPKQQVPTRMLDSNKQATLSTTELNTELATPSFPLLETSNETSFLIGINEESVEGTAVYLPGPDRCKMNPCLNGGTCYPTETSYVCTCVPGYSGDRCELDFDECHSNPCRNGATCIDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSTGEDCVVIIWHENGQWNDVPCNYHLTYTCKKGTVACGQPPVVENAKTFGKMKPRYEINSLIRYHCKDGFIQRHLPTIRCLGNGRWAMPKITCLNPSAYQRTYSKKYFKNSSSAKDNSINTSKHDHRWSRRWQESRR

SEQ ID NO: 300 - protein, 3562 aa, Gallus gallus
  CHICKEN VERSICAN Q90953
MLLNIKSIIWMCSTLAITYMLPKVKAEKKTLVKGSLSGTSVLPCFFSTTPTIASSYAAEYLRIKWSKVELDKSGKDAKETTVLVAQNGNIKIGQNYKDRVSVPTHSEETGDASLTFSRLRASDAGVYRCDVMYGVEDTQGIVSLAVDGVVFHYRAATSRYTLNFTQAQQTCLDNGAVIASPEQLKAAYEDGFEQCDAGWLSDQTVRYPIRHPRIGCFGDKMGKKGVRTYGRRFPNETYDVYCYVEHMQDEVVHVSVPEKLTFEEAKELCRKRDGVLASVGNMYVAWRNGFDQCDYGWLADGSVRYPASVARPQCGGGLLGVRTLYRYENQTGFPYPDSKFDAYCYERKKIVSEPTTVKLVTTLKTDSVELSSAKVTLKPSVFESSVTEVAVTKTKVPAWEEATLETEDTKMTTEVAEEKREMEVLMENIKLTTLLPQTVTDGEISPYDTLGRTEYDVSPRLTESTSAALEVEHTYSEAELSEEQGRSESTEDAFLTSVVFQDSTAVAKSSTGSWEDIETGDTQKHDGDNQTEQIEVGPVMTATDSLVPASQRELPRTGSSVSLTKENLYLGSHSTKEPTKKSMEAKSDKKLTTVVIPKALFTDQYDLTTGGEGRESMYTVMPDRVSGVALVSIPESDVPAVSETLMDELAVTTGQSSTADESTPFIKFSSSATELDNEASAEGSREDLKDVHLTTSSGIPVSFTLFTANETGSEVTALSESTSAPQKFEEGITSVLHSSQQTEGSAILEKQEKTKEPEMSTIDAKVLYITTVVPASVTAGSEGRFGSEKFTHTPPVSGMWLQTDKDQVYMTEETSHTKRIELDTEDDISGMEPTSSPGQIIEYTKHLGAPVSAVTDETKTSMETAETESDEEVVSADFDQTKGTTEVFHTSSSLDLEKFTLSKIPEDESSATVKSFSSSSGTVLPTAVATVLEVTDHEADETSGYVLNMTFSTPEGEQRKATEKSPATSAEDEVSTGTEISKYTMTEGGQISSVTSAEKESVAALQEREEQPSVGLPETKEPFKFTDVTEIETTVPQREGDTSLVPVTVGSEDIGEMQVTDHTSFDSIIHTEATVTSTKASEVFPKELSTKDQDRELGTAMGSTLPVTSVQMHEQKTTAGFESPQTTTQEKHDEMGSAYDEMYPATELSVPALMLTEYGQVSGPVETSTRSLHLTGTPKAETATDQEEKITEAVPVTFGTQAKVYESKGTTTREEDRDVGSWNSVLPPHTMLSSPSTAGSISLLTLGASPSQTPEGSGISEELEEVKTVPFSSRATDKTTVISDLTTSSISAVDKIQPTSASKPFVSSKSPRIIPEEDEEVTSSDIIVIDESISPSKASAEDDLTGKMVEPEIDKEYFTSSTATAVARPTAPPTVMEATEALQPQEVSPTSHPDSGTDIRLYVIQITGNDTDHPVNEFLDLFSRHILPHAVDETHTDAESAQTEPCTSDSVQDSSEYIILDPFFPNFMDFEEEEEDCENTTDVTTPPALQFINGKQQVTSAPKSTKAEEARSDQIESVAHSKNVTFSQINETNTFIISETEASGTMQPSKAGEVMGAFEVTQPTADVAMLEPVYSGESEVTTTDKYLEITSVYEQSPKKNKETVMWHGTEESSTKDTKNLLLITNESSGDGSTESDLSRSVFTEILTMSSHEDSEKISHTTSVPTILSVERSAVTAAPSADSDTATVGIDVKDLIPKGGTATPGNYYKSTIKLDAEFPFESNPEATSHTTKPDMTASSFIVLEGSGDVEENSTLASAMTTETAVAETLSVQDTSLGSGTVLPTEISVTISEITPALPGGTRILYSTFDQSSEATVSTNFVSELIMEQVVGSSVATEKKVEDEKEVQTTVYSSQEISTTDAKGKSELDEFGSTTNEVRTVSQEPTPLREIVPITGTMHSEIKKVTATPFLREKLFINEGSAEEPADLFAGSPTRKVVSTDSPFTDSGSGDIDVITESATLTSVPSRSVIETQTVKHEGNINVISVSLKNTTTEYEEHIGTGGPVTSVSSTGSDGLTEESEVAIEMSENVFSTENQGEPTQEAVPTYTAPSDIKSRLGSRREVTSHVTPVIRTKDLETAEVTSSPESVVNNSTLDTMVTHGTIRAVAESTESKKGKGSFSAVSLGKILMIEHGSGEELKVDSSTTKLMSNGPTEKLLGSHFSFFDQGSGEAETLTESFTKASVSPTGKPEPQEQYGRKTVSMPSAVVHAYTAEPNELVTSTEHDITSLQTVTDTEMEEKAANELTVTSFATNLPLSEDVHSWEDRPREILPKAIESSGEATEDPFFISTQANHEHVEFLSVPTIRPHSEENKVEAESDEKILLPFNNDRVTESAVIERKYLSSPFTDTEQEEELVQNIFPTEDIPRLFLTPKEEKPTNNELISDPLFSGQGSGDEFTVIPSVESLAVKETTNTLSPWPFHPASVGPKLSTDKTQVFESGSTDSNAEINEEITTTAAELTETAYSMATSSPALEEESSSHSNSKDKDITHYFLVIEDPYNKEMDHRRGENGTSRPLPTPGDVSLEESSHMLTTDDVTPVSVILSETPYLEMGKSLATSATKMPSRVLPESSGEGSGWDGVSDSFAPDTLTHSTAPSVMEVELTASSHIPGVYSEVMTTHVPGDGSQTVITGLASLFTEEKEIVANRTAADPKTGTSEELTSDTGMSLDIIPVVDDRRHVTLNVSVYGDITLIEERLQIPSEKTTIIDMDHSKSMPEDIISVQTMPNLVIRSTQVSDDNMKAEEDKYDSILNFSTVEENSFGSGDNLSLTTSIQPSSESVTAGHGPKLVDKDLGSGYAMQFATETLTTTVLNELGIFLPTVPSLVSPHMPHESKESEFEAKHIGRTSTTDDVYEPYTSANNQVITDQSKTMSISGFSGMGQEESGDKKPMIPSLTPDLTMETEKALTTDTFDVSMVTTQSMSQHATVSSSSSEEKHSTVYMQTKSASTEYEETDSVSLNSVSQNPKSSVTVWLVNGVSKYPEVIIPSTSSAKDSDQSDHSSDGTFKEVSSDMAATYKPPTTDLDTTVSSLLVFSPEPESESISTESTPHFNKFVTERSEETESSVNDLIIEENATVSGDSPSIHDYPTAFWNFGERTSTDVPKLSTIEVEFSSERVKNPSQESDRSTERERPRLSSAPVSDSPNSIEVGVFKPDQEAVTMLTSSLEPLDRSLETQSALLGPLLGQQEITTISSNIATNNTAPGNNPYSNEQSTISSELLNTIELVTSSFSLPEVTNGSDFLIGTSVGSVEGTAVQIPGQDPCKSNPCLNGGTCYPRGSFYICTCLPGFNGEQCELDIDECQSNPCRNGATCIDGLNTFTCLCLPSYIGALCEQDTETCDYGWHKFQGQCYKYFAHRRTWDTAERECRLQGAHLTSILSHEEQVFVNRIGHDYQWIGLNDKMFERDFRWTDGSPLQYENWRPNQPDSFFSAGEDCVVIIWHENGQWNDVPCNYHLTYTCKKGTVACGQPPVVENAKTFGKMKPRYEINSLIRYHCKDGFIQRHIPTIRCQGNGRWDMPKITCMNPSTYQRTYSKKYYYKHSSSGKGTSLNSSKHYHRWIRTWQDSRR

SEQ ID NO: 301 - protein, 1268 aa, Mus musculus
  Mouse Neurocan P55066
MGAGSVWASGLLLLWLLLLVAGDQDTQDTTATEKGLRMLKSGSGPVRAALAELVALPCFFTLQPRLSSLRDIPRIKWTKVQTASGQRQDLPILVAKDNVVRVAKGWQGRVSLPAYPRHRANATLLLGPLRASDSGLYRCQVVKGIEDEQDLVTLEVTGVVFHYRAARDRYALTFAEAQEACRLSSATIAAPRHLQAAFEDGFDNCDAGWLSDRTVRYPITQSRPGCYGDRSSLPGVRSYGRRDPQELYDVYCFARELGGEVFYVGPARRLTLAGARAQCQRQGAALASVGQLHLAWHEGLDQCDPGWLADGSVRYPIQTPRRRCGGPAPGVRTVYRFANRTGFPAPGARFDAYCFRAHHHTAQHGDSEIPSSGDEGEIVSAEGPPGRELKPSLGEQEVIAPDFQEPLMSSGEGEPPDLTWTQAPEETLGSTPGGPTLASWPSSEKWLFTGAPSSMGVSSPSDMGVDMEATTPLGTQVAPTPTMRRGRFKGLNGRHFQQQGPEDQLPEVAEPSAQPPTLGATANHMRPSAATEASESDQSHSPWAILTNEVDEPGAGSLGSRSLPESLMWSPSLISPSVPSTESTPSPKPGAAEAPSVKSAIPHLPRLPSEPPAPSPGPSEALSAVSLQASSADGSPDFPIVAMLRAPKLWLLPRSTLVPNMTPVPLSPASPLPSWVPEEQAVRPVSLGAEDLETPFQTTIAAPVEASHRSPDADSIEIEGTSSMRATKHPISGPWASLDSSNVTMNPVPSDAGILGTESGVLDLPGSPTSGGQATVEKVLATWLPLPGQGLDPGSQSTPMEAHGVAVSMEPTVALEGGATEGPMEATREVVPSTADATWESESRSAISSTHIAVTMARAQGMPTLTSTSSEGHPEPKGQMVAQESLEPLNTLPSHPWSSLVVPMDEVASVSSGEPTGLWDIPSTLIPVSLGLDESVLNVVAESPSVEGFWEEVASGQEDPTDPCENNPCLHGGTCHTNGTVYGCSCDQGYAGENCEIDIDDCLCSPCENGGTCIDEVNGFICLCLPSYGGSLCEKDTEGCDRGWHKFQGHCYRYFAHRRAWEDAERDCRRRAGHLTSVHSPEEHKFINSFGHENSWIGLNDRTVERDFQWTDNTGLQYENWREKQPDNFFAGGEDCVVMVAHESGRWNDVPCNYNLPYVCKKGTVLCGPPPAVENASLVGVRKIKYNVHATVRYQCDEGFSQHRVATIRCRNNGKWDRPQIMCIKPRRSHRMRRHHHHPHRHHKPRKEHRKHKRHPAEDWEKDEGDFC

SEQ ID NO: 302 - protein, 1257 aa, Rattus norvegicus
  Rat Neurocan P55067
MGAESVWASGLLVLWLLLLVSGDQDTQDTTTTEKGLHMLKSGSGPIQAALAELVALPCFFTLQPRQSPLGDIPRIKWTKVQTASGQRQDLPILVAKDNVVRVAKGWQGRVSLPAYPRHRANATLLLGPLRASDSGLYRCQVVKGIEDEQDLVTLEVTGVVFHYRAARDRYALTFAEAQEACHLSSATIAAPRHLQAAFEDGFDNCDAGWLSDRTVRYPITQSRPGCYGDRSSLPGVRSYGRRDPQELYDVYCFARELGGEVFYVGPARRLTLAGARALCQRQGAALASVGQLHLAWHEGLDQCDPGWLADGSVRYPIQTPRRRCGGSAPGVRTVYRFANRTGFPAPGARFDAYCFRAHHHTPQRGDSEIPSSGDEGEIVSAEGPPAPELKPRLGEQEVITPDFQEPLVSSGEDEPLDLTRTQASQETLASTPGGPTLASWLLTGVTSSTGVPSPSSLGVDMEETTPSGTQVAPTPTMRRGRFKGLNGRHFQQQGPEDQLLEAAEASAQPPTLEVTADHMGPSAATEALESDQSHSPWAILTNEVDVPGAGSLGSRSLPESRKWSPSLISPSTVPSTDSTPGLKPGADEAPGVKSAIHHPPWLPSEPAVPSSIPSEALSAVSLQASPGDGSPDFPIVAMLRAPKLWLLPHSTLVPNVSPIPLSPASPLPSSVPEEQAVRPVSFGAEDPETPFQTTMAAPGEASHGSPEADSIEIEGISSMQATKHPISGPWASLDSSNVTVNPVPSDAGILGTESGVLDLPGSPTSDGQATVDMVLATWLPLPGHGLDTGSQSTPMEAHGVTMSVEPTVALEGGATKDPMEATMDVVPSTVDATSGSEPKSSISSTHVVVTAAGDQGTPTLTPTSSEGQVVAQESLGTLTSLPSHPWSSLASSMDEVASVSSGEPTRLWDIPSTLIPVSLGLDESDLKVVAESPGLEGFWEEVASGQEDPTDPCENNPCLHGGTCRTNGTMYGCSCDQGYAGENCEIDIDDCLCSPCENGGTCIDEVNGFICLCLPSYGGNLCEKDTEGCDRGWHKFQGHCYRYFAHRRAWEDAERDCRRRAGHLTSVHSPEEHKFINSFGHENSWIGLNDRTVERDFQWTDNTGLQYENWREKQPDNFFAGGEDCVVMVAHENGRWNDVPCNYNLPYVCKKGTVLCGPPPAVENASLVGVRKVKYNVHATVRYQCDEGFSQHHVATIRCRSNGKWDRPQIVCTKPRRSHRMRRHHHHPHRHHKPRKEHRKHKRHPAEDWEKDEGDFC

SEQ ID NO: 303 - protein, 1321 aa, Pan troglodytes
  Chimpanzee Neurocan Q51S41
MGTPFVWALGLLMLQMLLFVAGEQGTQDIADASERGLHMQKLGSGSVQAALAELVALPCLFTLQPQPSAARDAPRIKWTKVRTASGQRQDLPILVAKDNVVKVAKSWQGRVSLPSYPRRRANATLLLGPLRASDSGLYRCQVVRGIEDEQDLVPLEVTGVVFHYRSARDRYALTFAEAQEACRLSSAIIAAPRHLQAAFEDGFDNCDAGWLSDRTVRYPITQSRPGCYGDRSSLPGVRSYGRRNPQELYDVYCFARELGGEVFYVGPARRLTLAGARAQCRRQGAALASVGQLHLAWHEGLDQCDPGWLADGSVRYPIQTPRRRCGGPAPGVRTVYRFANRTGFPSPAERFDAYCFRAHHPTSQHGDLETPSSGDEGEILSAEGPPVRELEPTLEEEEVVTPDFQEPLVSSGEEEPLILEEKQESQQTLSPTPGDPMLASWPTGEVWLSTVAPSPSDMGAGTAASSHTEVAPTDPMPRRRGRFKGLNGRYFQQQEPEPGLQGGMEASAQPPTSEAAGNQMEPPLAMAVTEMLGSGQSRSPWADLTNEVDMPGAGSAGGKSSPEPWLWPPTMVPPSISGHSRAPVLELEKAEGPSARPATPDLFWSPLEATVSAPSPAPWEAFPVATSPDLPMMAMLRGPKEWMLPHPTPISTEANRVEAHGEATTTPPPSPAAETKVYSLPLSLTPTGQGGEAMPTTPESPGADFRETGETSPAQVNKAEHSSSSPWPSVNRNVAVGFVPTETATEPTGLRGISGSESGVLDTAESPTSGLQATVDEVQDPWPSVYSKGLGASSPSAPLGSPGVFLVPKVTPSLEPWVATDEGPTVNPMDSTVTLAPSDASGIWEPGSQVFEEAESTTLSPQVALDTSIVTPLTTLEQGDKVGVPAMSTLGSSSSQPHPEPEDQVETQGTSGASVPPHQSSPLGKPAVPPGTPTAASVGESASVSSGEPTVPWDPSSTLLPVTLGIEDFELEVLAGSPGVESFWEEVASGEEPALPGTPMKAGAEEVHSDPCENNPCLHGGTCNANGTMYGCSCDQGFAGENCEIDIDDCLCSPCENGGTCIDEVNGFVCLCLPSYGGSFCEKDTEGCDRGWHKFQGHCYRYFAHRRAWEDAERDCRRRSGHLTSVHSSEEHSFINSFGHENTWIGLNDRIVERDFQWTDNTGLQFENWRENQPDNFFAGGEDCVVMVAHESGRWNDVPCNYNLPYVCKKGTVLCGPPPAVENASLIGARKAKYNVHATVRYQCNEGFAQHHVATIRCRSNGKWDRPQIVCTKPRRSHRMRRHHHHHQHHHQHHHHKSRKERRKHKKHPTEDWEKDEGNFC

SEQ ID NO: 304 - protein, 381 aa, Mus musculus
  Mouse Layilin Q8C351
MQPGAALQAMLLAVLLAKPRDSKGRLLSASDLDPRGGQLVCRGGTRRPCYKVIYFHDAFQRLNFEEAKETCMEDGGQLVSIETEDEQRLIEKFIENLLASDGDFWIGLKRLEEKQSNNTACQDLYAWTDGSTSQFRNWYVDEPSCGSEVCVVMYHQPSAPPGIGGSYMFQWNDDRCNMKNNFICKYHDDKPSTTPSIWPGGEATEPATPLLPEETQKEDTKETFKERREAALNLAYILIPSIPLFLLLVVTSAVCWVWICRRKREQTDPSTKEQHTIWPTPRQENSPNLDVYNVIRKQSEADLAEPRPDLKNISFRVCSGEAMPDDMSCDYENIAVNPSESGFVTLASMESGFVTNDIYEFSPDRMGRSKESGWVENEIYY

SEQ ID NO: 305 - protein, 374 aa, Cricetulus griseus
  Chinese Hamster Layilin Q9Z209
MQPGPALQAVLLAVLLSEPRSSKGRLLSGQLVCRGGTRRPCYKVIYFHDAFQRLNFEEAKEACRRDGGQLVSIETEDEQRLIEKFIENLLASDGDFWIGLRRLEVKQVNNTACQDLYAWTDGSTSQFRNWYVDEPSCGSEVCVVMYHQPSAPPGIGGSYMFQWNDDRCNMKNNFICKYADEKPSTTPSIRPGGEATEPPTPVLPEETQKEDTKETFKESREAALNLAYILIPSIPLFLLLVVTSAACWVWICRRRKQEQPDPTTKEQHTIWPTPHQENSPNLDVYNVIRKQSEADLTEPRPDLKNISFRVCSSEAPPDDISCDYDNMAVNPSESGFVTLASMESGFVTNDIYEFSPDRMGRSKESGWVENEIYY

SEQ ID NO: 306 - protein, 376 aa, Rattus norvegicus
  Rat Layilin NP_001178926
MQPGAALQAMLLAVLLAKPRDSKGHLLSGDLDPRGGQRFCWEGTRRPCYRVIYFHDTSQRRNFEEAKEACMKDGGQLASIETADEQRLIENFIESLQASDGDFWIGLKRLEEKQHNSTACQDLYAWTDGSLSQFRNWYMDEPSCESEVCVVMYHQPSAPPGIGGPYMFQWNDDRCNTKKNFICKYSDDKPSTTPSLSPGGEATEPAAPILPEETLEIDTKERREAALNLAYILIPSIPLFLLLVVTSAVCWVWICRRKREQTDPPTKEQHTIWPTPHQENSPDLEVYNVIRKQSEADLAEPRPDLKNISFRVCSGEAMPDDTSCDYDNMVINPSESGLVTLASMEGRFVTNDIYEFSPDRMGRSKESGWVENEIYY

SEQ ID NO: 307 - protein, 794 aa, Mus musculus
  Mouse RHAMM Q00547
MSFPKAPLKRFNDPSGCAPSPGAYDVKTSEATKGPVSFQKSQRFKNQRESQQNLNIDKDTTLLASAKKAKKSVSKKDSQKNDKDVKRLEKEIRALLQERGTQDKRIQDMESELEKTEAKLNAAVREKTSLSASNASLEKRLTELTRANELLKAKFSEDGHQKNMRALSLELMKLRNKRETKMRSMMVKQEGMELKLQATQKDLTESKGKIVQLEGKLVSIEKEKIDEKCETEKLLEYIQEISCASDQVEKCKVDIAQLEEDLKEKDREILSLKQSLEENITFSKQIEDLTVKCQLLETERDNLVSKDRERAETLSAEMQILTERLALERQEYEKLQQKELQSQSLLQQEKELSARLQQQLCSFQEEMTSEKNVFKEELKLALAELDAVQQKEEQSERLVKQLEEETKSTAEQLTRLDNLLREKEVELEKHIAAHAQAILIAQEKYNDTAQSLRDVTAQLESVQEKYNDTAQSLRDVTAQLESEQEKYNDTAQSLRDVTAQLESEQEKYNDTAQSLRDVTAQLESVQEKYNDTAQSLRDVTAQLESYKSSTLKEIEDLKLENLTLQEKVAMAEKSVEDVQQQILTAESTNQEYARMVQDLQNRSTLKEEEIKEITSSFLEKITDLKNQLRQQDEDFRKQLEEKGKRTAEKENVMTELTMEINKWRLLYEELYEKTKPFQQQLDAFEAEKQALLNEHGATQEQLNKIRDSYAQLLGHQNLKQKIKHVVKLKDENSQLKSEVSKLRSQLVKRKQNELRLQGELDKALGIRHFDPSKAFCHASKENFTPLKEGNPNCC

SEQ ID NO: 308 - protein, 498 aa, Rattus norvegicus
  Rat RHAMM Q9WUF7
MGGGVSYVGWLEKSETEKLLEYIEEISCASDQVEKYKLDIAQLEEDLKEKDREILCLKQSLEEKVSFSKQIEDLTVKCQLLEAERDDLVSKDRERAESLSAEMQVLTEKLLLERQEYEKLQQNELQSQSLLQQEKELSAHLQQQLCSFQEEMTSERNVFKEQLKLALDELDAVQQKEEQSEKLVKQLEEETKSTAEQLRRLDDLLREKEIELEKRTAAHAQATVIAQEKYSDTAQTLRDVTAQLESYKSSTLKEIEDLKLENLTLQEKVAMAEKRVEDVQQQILTAESTNQEYAKVVQDLQNSSTLKEAEIKEITSSYLEKITDLQNQLRQQNEDFRKQLEEEGAKMTEKETAVTELTMEINKWRLLYEELYDKTKPFQQQLDAFEAEKQALLNEHGATQEQLSKIRDSYAQLLGHQNLKQKIKHVVKLKDENSQLKSEVSKLRSQLAKRKQNELRLQGELDKALGIRHFDPPKAFCHESKENVTLKTPLKEGNPNCC

SEQ ID NO: 309 - protein, 907 aa, Mus musculus
  Mouse Inter-alpha-trypsin inhibitor heavy chain H1 Q61702
MEGATGLRVLLCLLPLLTLQARPALGLATGRPRGSEKRHAVDTSVNGVSIKSLKVNCKVTSRFAHYVITSQVVNNADKAREVAFDVEIPKTAFISDFAITSDGKAFIGDIKDKVTAWKQYRKAAVLGESAGLVRASGRNMEQFTIHITVGAQSKATFRLTYEEVLKRRLMQYDITIKVRPKQLVQHFEIDVDIFEPQGISKLDAQASFLSEELAAQTIKKSFSGKKGHVLFRPTVSQQQSCPTCSTSLLNGEFKVTYDVNRDKLCDLLVANNYFTHFFAPKNLTNMSKNLVFVIDISGSMEGQKVRQTKEALLKILEDMRPVDNFDLVLFGSKVQSWKGSLVPASNANLQAAQDFVRRFSLAGATNLNGGLLRGIEILNKAQGSHPELSSPASILIMLTDGEPTEGETDRSQILKNVRNAIRGRFPLYNLGFGHDLDFSFLEVMSTENNGWAQRIYEDHDATQQLQGFYNQVANPLLTDVELQYPQDAVLALTQHRHKQYYDGSEIVVAGRIANHKLNTFKADVRARGEKQEFRATCLVDEEEMKKLLRERGHVLENHVERLWAYLTIQELLAKRMKTEGEERANLSSQVLKMSLDYHFVTPLTSLTIRGLTDEDGLEPTIDKPLEDSQPLEMVGPRRTFVLSAIQPSPTAHPIDSKLPLRVTGVDTDPHFIIYVPSKEDSLCFNINEEPGVILNLVQDPDTGFTVNGQLIGNKASSPGQHESTYFGRLGISSPTSDFQLEVTPQNITLNPSSSGSMFSWRDQAVLQKDGVVVTINKKRNLVVSVDDGATFEIVLHRTWKGSAVHQDFLGFYVLDSFRMSARTKGLLGQFFSPLDFEVFDLHPGSDPTKTDATMVVKNRQLTVTRGLQKDYSKDPRHGAEVPCWFVHDNGAGLIDGVHTDYVVSDIF

SEQ ID NO: 310 - protein, 946 aa, Mus musculus
  Mouse Inter-alpha-trypsin inhibitor heavy chain H2 Q61703
MQRPVCLLIWLFLLEAQAFEIPINGNSEFAEYSDLVELAPDKLPFVQENGRHQRSLPEESGEETDTVDPVTLYSYKVQSTITSRVATTTIQSKLVNNSPLPQSVVFDVQIPKGAFISNFTMTVNGMTFTSSIKEKTVGRALYSQARAKGKTAGWVRSRTLDMENFNTEVNIPPGAKVQFELHYQEVKWRKLGSYEHKIHLQPGKLAKHLEVNVWIIEPQGMRFLHVPDTFEGHFQGVPVISKGQQKAHVSFKPTVAQQRKCPNCTETAVNGELVVMYDVNREEKAGELEVFNGYFVHFFAPENLDPIPKNILFVIDVSGSMWGIKMKQTVEAMKTILDDLRTDDQFSVVDFNHNVRTWRNDLVSATKTQIADAKRYIEKIQPSGGTNINEALLRAIFILNEASNMGLLNPDSVSLIILVSDGDPTVGELKLSKIQKNVKQSIQDNISLFSLGIGFDVDYDFLKRLSNENRGIAQRIYGNQDTSSQLKKFYNQVSTPLLRNVQFNYPQASVTDVTQNNFHNYFGGSEIVVAGKFDPSKLTEVQSIITATSANTELVLETLSQMDDLEEFLSKDKHADPDFTKKLWAYLTINQLLAERSLAPTAAIKRKITKTILQMSLDHHIVTPLTAMVIENDAGDERMLADSPPQDHSCCSGALYYGTKVASGPIPSWANPSPTPMSAMLAVGAKPLESTPPTHLNQVENDPHFIIYLPKSKRNICFNIDSEPGKILSLVSDPESGIVVNGQLIGAKRAENGKLSTYFGKLGFYFQKEGMKIEISTETITLSSGSSTSRLSWSDTAHLGNSRVLISVKKEKSVTLTLNKELFFSVLLHRVWRKHPVNVDFLGIYAPPIDKFSPRVHGLLGQFMQEPAIHIFNERPGKEPGKPEASMEVKGHKLTVTRGLQKDYRTDIVFGTDVPCWFVHNSGKGFIDGHYKDYFVPQLYSFLKRP

SEQ ID NO: 311 - protein, 889 aa, Mus musculus
  Mouse Inter-alpha-trypsin inhibitor heavy chain H3 Q61704
MRTMWWPCLVLALLSGLETSGFPRSPLQLLGKRSLPEGVVDGIEVYSTKISCKVTSRFAHNVVTTRAVNRADTAKEVSFDVELPKTAFITNFTLTIDGVTYPGNVKEKEVAQKQYEKAVSQGKTAGLVKASGRKLEKFTVSVNVAAGSKVTFELTYEELLKRNKGKYEMYLKVQPKQLVRHFEIDAHIFEPQGISMLDAEASFITNDLLGSALTKSFSGKKGHVSFKPSLDQQRSCPTCTDSLLNGDFTIVYDVNRESPGNVQIVNGYFVHFFAPQGLPVVPKNIVFVIDVSGSMSGRKIQQTREALLKILDDVKEDDYLNFILFSTDVTTWKDHLVQATPANLKEAKTFVKNIHDQSMTNINDGLLKGIEMLNKAREDHTVPERSTSIIIMLTDGDANTGESRPEKIQENVRNAIGGKFPLYNLGFGNNLNYNFLETLALENHGLARRIYEDSDANLQLQGFYEEVANPLLTNVEVEYPENAILDLTRNSYPHFYDGSEIVVAGRLVDRNMDNFKADVKGHGALNDLTFTEEVDMEEMDAALKEQGYIFGDYIERLWAYLTIEQLLEKRKNAKGDEKENITAEALDLSLKYHFVTPLTSMVVTKPEDNEDQTSIADKPGEEAIAETTTMSFLTTQQSSQSPYYYVDGDPHFIIQIPGKNDSICFNIDEKPGTVLRLIQDPVTGITVTGQIIGDKRSNASSRTGKTYFGKLGITNAWMDFRVEVTTEKIILGTGAELSTFSWLDTITVTQTGLSVTINRKKNMVVSFGDGISFVIILHQVWKKHPVHQDFLGFYVVDSHRMSAQTHGLLGQFFQPFDFKVFGIRPGSDPTKPDATMVVKNHRLTVTRGSQKDYRKDASVGTKVICWFVHNNGEGLIDGVHTDYIVPSLF

SEQ ID NO: 312 - protein, 906 aa, Bos taurus
  Cow Inter-alpha-trypsin inhibitor heavy chain H1 Q0VCM5
MGLRGLLCVCLVSLLALQAVAAQGSPTRNPKGGKKRMAVDAAVDGVVIRSLKVNCKVTSRFAHYIITSQVVNSADTAKEVSFNVEIPKTAFISDFAITADENAFTGDIKDKVTAWKQYRKAAISGENAGLVRASGRTMEQFSIHIIVGPRSKATFRLTYEEVLRRKLMQYDIVIKVKPQQLVQHFEIDVDIFEPQGIRKLDVEASFLPKELAAQLIKKSFSGKKGHVLFRPTVSQQQTCPTCSTTLLNGDFKVTYDVNRDDACDLLVANNYFAHFFAPQNLKKLNKNVVFVIDISSSMEGQKLKQTKEALHKILGDMRPGDYFDLVLFGSAVQSWKGSLVQASPANLEAARNFVQQFSLAGATNLNGGLLRGIEILNKAQQSLPELSNHASILIMLTDGEPTEGVMDRTQILKNVRDGIKGRFPLYNLGFGHDVDLNFLEVMSLENNGRVQRIYEDHDATQQLQGFYEQVANPLLRDVELLYPREAVSDLTQHRHKQYYEGSEIMVAGRIADHKLSSFKADVRAHGEGQEFMTTCLVDKEEMKKLLRERGHMLENHVERLWAYLTIQELLAKRMKLEGQEKANVSAKALQMSLAYQFVTPLTSMTVRGMTDQDGLEPIIDKPLDDYLPLEMVGPRKTFMLQASQPAPTHSSLDIKKLPDQVTGVDTDPHFLIHVPQKEDTLCFNINEEPGVVLSLVQDPDTGFSVNGQLIGNEAGSPGKHEGTYFGRLGIANPATDFQLEVTPQNITLNPGSGGPVFSWRDQAFLRQNEVLVTINRKRNLVVSVEDGGTFEVVLHRVWRGSAVRQDFLGFYVLDSHRMSARTHGLLGQFFHPFDYKVSNLHPGSDPTKTDATMVVKNRRLTVTRGLQKDYRKDPRHGAEVTCWFIHNNGDGLIDGIHTDYIVPDIF

SEQ ID NO: 313 - protein, 946 aa, Bos taurus
  Cow Inter-alpha-trypsin inhibitor heavy chain H2 NP_001091485
MKGLTCFFLCFFLSESRGFEIPTNGLSEFADYGDHVELAPGKFQFVPENRRYQRSISGESGERTEDVDQVTVYSYKVQSTITSRVANTVIQTKVVNHSPQPQNVVFDVQIPKGAFISNFSMTVDGTTFTSSIKEKTVGRALYAQARAKGKTAGLVRSRALDMEDFKTEVSIAPGAKVQFELHYQEVKWRKLGSYEHRLHLKPGRLAKHLEVDVRIIEPQGLRSLHVLDTFDGHFDGVPVVSKGPQKAHIAFKPTVAQQRKCLNCSETMVDGELVVMYDVNREEKVGELEVFNGYFVHFFAPENMDPIPKNILFVIDVSGSMWGIKMKQTVEAMKTILDDLRTEDHFSVVDFNHNVRTWRNDLVSATKTQVADAKNYIEKIQPSGGTNINEALLRAIFILNEANNLGMLDPNSVSLIILVSDGDPTVGELKLSKIQKNVKQNIRDNISLFSLGIGFDVDYDFLKRLSNDNRGIAQRIYGNQDTSVQLKKFYNQVSTPLLRNVQFNYPQPSVTDVTQNSFHNYFGGSEIVVAGKVDPEKLGQLQSIITATSANAELVLETLAEMDGLEDFLSKDKHADPDFTKKLWAYLTINQLLAERSLAPTAAMKRKITKTILQMSLDHHIVTPLTAMVIENEAGDERMLADSPPQDHSCCSGALYHGSKVSPNSVPSWVNPSPAPVLPMPAVGAQVLESTPPPHVMRVENDPHFIIYLPKSQKNICFNIDSEPGKILNLVSDPELGILVNGQLVGAKKPKNKKLSTYFGKLGFYFQREDVKVEISTETISLSRGSRTSVLSWSDTAHVLNQRVLVSVKKEKTVTVTLDKEMFFSVLLHRVWKKHPINVDFLGIYIPPTNKFSPNVHGLIGQFMNEPKIHVFNERPGKDPEKPEASMEVKGQKLVVTRGLQKDYRTDRVFGTDVPCWFVHNSGKGFIDGHYKDYFVPQLYSFLRRP

SEQ ID NO: 314 - protein, 891 aa, Bos taurus
  Cow Inter-alpha-trypsin inhibitor heavy chain H3 P56652
MALAQWPYLILALLSGLAVSGFPRNPSLLLGKRSLPGRAVDGIEVYSTKVNCKVTSRFAHNVVTTRAVNHANTAKEVSFDVELPKTAFITNFTLTIDGVTYPGKVKEKEVAKKQYEKAVSQGKTAGLVKASGRKLEKFTVSVNVAAGSKVTFELTYEELLKRHKGKYEMYLKVQPKQLVKHFEITVDIFEPQGISTLDAEASFITNDLLGSALTKSFSGKKGHVSFKPSLDQQRSCPTCTDSLLKGDFIITYDVNRESPANVQIVNGYFVHFFAPQGLPVVPKSVVFVIDVSGSMHGRKMEQTKDALLKILEDVKQDDYLNFILFSGDVTTWKDSLVPATPENIQEASKFVMDIQDRGMTNINDALLRGISMLNKAREEHTVPERSTSIIIMLTDGDANVGESRPEKIQENVRNAIGGKFPLYNLGFGNNLNYNFLENMALENHGLARRIYEDSDANLQLQGFYEEVANPLLTGVEVEYPQNAILDLTQNSYQHFYDGSEIVVAGRLADEDMNSFKAAVKGHGAINDLTFTEEVDMKEMEKALQERDYIFGDYIERLWAYLTIEQLLDKRKNAQGEEKEILTAQALELSLKYHFVTPLTSMVVTKPEDNENQTAIANKPGEGPLDAEEVPSMAYLTSYQAPQTPYYYVDGDPHFIIQIPEKDDAICFNIDEDPGTVLRLIQDPVTGLTVNGQIIGEKTGRSDSQTRRTYFGKLGIASAQMDFRIEVTRENITLWNGDSLSTFSWLDTVMVTQDGLSVMINRKKNMVVSFGDGVTFVVVLHQVWKKEPAHHDFLGFYVVNSRGMSAQTHGLLGQFFHPFDFQVSDVHPGSDPTKPDATMVVKNHQLTVTRGSQKDYRKDISVGRNVACWFVHNNGQGLIDGIHRDYIVPNLF

SEQ ID NO: 315 - protein, 928 aa, Gallus gallus
  Chicken Interphotoreceptor matrix proteoglycan 1 SPACR Q8JIR8
MHLKTGLIFLAICLALQVQGSREIPSKTNHGEAKQLADASGSDKTERTTKRSRVSTIRRIFDMAKHRTKRSPFFSTGVKICPQESVKQILASHQAYYRLRVCQEAVWEAFRIFLDRIPDTSEYQNWVTACQRETFCIFDIGKNFSNSQEHLEIIQRRVKHRTFQERKDEISTDKTGGKKLEDIPSVSTGPPSASLSTYTLVPNGTLLNEIVNETKTPVKELGTNTVPELPAEQMVEFSVTLTDQEYTAELSDPNSPQYRQLAAKFQLQMQKIFEKLPGFKEIHVLGFKQKKEKDGSSSTIARYMVNFERDGSEIKSTADDISTIGSNKVENEKVPLSAKEEREISATKLTVTDLQQLVATALHEDRSLPVDLGTLRFTDEPIKPSSDFDNDIQGMVTIPLAGPDLDDTISAELPLVYPSPITVDQTRDIFVDEFTTGITDLSREIGGPEDFDSNFITSEPAFPTKPSREPPHDRSPDTEDITTDYQRFTVPFSALVSTDSPAKPEDSYLPPPADESDSNDLITDESPTEQVITPAVYTTGSFTLPTFLQATDKDTEAEMKKELVGVTEPLFKEADRDSLSGQAVKMMDELESSGDDILVTTSTYKTLPFLIGSSDLFATQPEVTFAAALPPDQTLLPTVTSPFYSHSVVIDQSPEVPDTLMPAAASALPDRASTGVQDIAAELDGAGVKSTAVLDEAEHGSGYISVQTTEPAEVTQAPTLKYVTTSSMTTAAKGKELVVFFSLRVTNMHFSDDLFNRSSQEYKALEQQFMQLLLPYLQSNLTGFKQLEILNFRNGSVIVNSKMKFARTVPYNITEAVHCVLEDFCDAAAQHLNLEIDSYSLDIEPADQADPCKFMACDEFSKCIMNEWTKEADCLCKPGYASQDGLPCRSLCEMEPHLCDNGGKCELVPGRGAVCRSPDQFTEPGLTS

SEQ ID NO: 316 - protein, 798 aa, Mus musculus
  Mouse Interphotoreceptor matrix proteoglycan 1 SPACR Q8RIW8
MNLQIKHAIFVLGIFLQVQGIKDTSIKIFSSEIKNIDKTPRIETIESTSTVHKVSTMKRIFDLPKLRTKRSALFPAANICPQESLRQILASLQEYYRLRVCQEVVWEAYRIFLDRIPDTEEYQDWVSLCQKETFCLFDIGKNFSNSQEHLDLLQQRIKQRSFPGRKDETASMETLEAPTEAPVVPTDVSRMSLGPFPLPSDDTDLKEILSVTLKDIQKPTTESKTEPIHVSEFSSEEKVEFSISLPNHRFKAELTNSGSPYYQELVGQSQLQLQKIFKKLPGFGEIRVLGFRPKKEEDGSSSTEIQLMAIFKRDHAEAKSPDSHLLSLDSNKIESERIHHGVIEDKQPETYLTATDLKKLIIQLLDGDLSLVEGKIPFGDEVTGTLFRPVTEPDLPKPLADVTEDATLSPELPFVEPRLEAVDREGSELPGMSSKDSSWSPPVSASISRSENLPSFTPSIFSLDAQSPPPLMTTGPTALIPKPTLPTIDYSTIRQLPLESSHWPASSSDRELITSSHDTIRDLDGMDVSDTPALSEISELSGYDSASGQFLEMTTPIPTVRFITTSSETIATKGQELVVFFSLRVANMPFSYDLFNKSSLEYQALEQRFTDLLVPYLRSNLTGFKQLEILSFRNGSVIVNSKVRFAKAVPYNLTQAVRGVLEDLRSTAAQGLNLEIESYSLDIEPADQADPCKLLDCGKFAQCVKNEWTEEAECRCRQGHESHGTLDYQTLNLCPPGKTCVAGREQATPCRPPDHSTNQAQEPGVKKLRQQNKVVKKRNSKLSAIGFEEFEDQDWEGN

SEQ ID NO: 317 - protein, 1243 aa, Mus musculus
  Mouse Interphotoreceptor matrix proteoglycan 2 SPACRCAN Q80XH2
MIMFLPVGRMSLGILILFLTGGNLVSASEERQEPMHAVSVLSPEKSTDLSLPTRKRQLLDATETGRRWLLRRRRSILFPNGVKICSSETVAEAVANHVKYFKARVCQEAIWEAFRTFWDRLPGRDEYRHWMNLCEDGVTSVFEMGAHFSQSVEHRNLIMKKLAYTREAESSSCKDQSCGPELSFPVPIGETSTLTGAVSSASYPGLASESSAASPQESISNEIENVTEEPTQPAAEQIAEFSIQLLGKRYSEELRDPSSALYRLLVEEFISEVEKAFTGLPGYKGIRVLEFRAPEENDSGIDVHYAVTFNGEAISNTTWDLISLHSNKVENHGLVEMDDKPTAVYTISNFRDYIAETLHQNFLMGNSSLNPDPKSLQLINVRGVLLPQTEDIVWNTQSSSLQVTTSSILDNTLQAEWLSADTTTTTTTTISPFGFSSSSPSATGRELQSQSALRDVVSTSKLASPTKVVLSSLPEILGGSSLTLHSVTPAVLQPDLPVAPEGRTSGSFILEDGLASTEELEDTSIDGLPSSPLIQPVPKETVPPMEDSDTALLSTPHLTSSAIEDLTKDIGTPSGLESLASNISDQLEVIPWFPDTSVEKDFIFESGLGSGSGKDVDVIDWPWSETSLEKTTKPLSKSWSEEQDALLPTEGREKLHIDGRVDSTEQIIESSEHRYGDRPIHFIEEESHVRSTIPIFVESATPPTSPIFSKHTSDVPDIDSYSLTKPPFLPVTIAIPASTKKTDEVLKEDMVHTESSSHKELDSEVPVSRPDMQPVWTMLPESDTVWTRTSSLGKLSRDTLASTPESTDRLWLKASMTQSTELPSTTHSTQLEEEVIMAVQDISLELDQVGTDYYQSELTEEQHGKADSYVEMSTSVHYTEMPIVALPTKGGVLSHTQTAGALVVFFSLRVTNMLFSEDLFNKNSLEYKALEQRFLELLVPYLQSNLSGFQNLEILSFRNGSIVVNSRVRFAESAPPNVNKAMYRILEDFCTTAYQTMNLDIDKYSLDVESGDEANPCKFQACNEFSECLVNPWSGEAKCKCYPGYLSVDELPCQSLCDLQPDFCLNDGKCDIMPGHGAICRCRVGSNWWYRGQHCEEFVSEPFVIGITIASVVSFLLVASAVVFFLVKMLQAQNVRRERQRPTSSSRHPDSLSSVENAMKYNPAYESHLAGCELYEKSYSQHPFYSSASEEVIGGLSREEIRQMYESSDLSKEEIQERMRILELYANDPEFAAFVREHQMEEL

SEQ ID NO: 318 - protein, 1241 aa, Rattus norvegicus
  Rat Interphotoreceptor matrix proteoglycan 2 SPACRCAN P70628
MIMFLPLGRISLGILILFLTGGNLVSVSEEIQDRMHAVAVLSPKESTDLSLPTRKRQLLDATETGRRWPLRRRRSILFPNGVRICPSDTVAEAVANHVKYFKARVCQEAIWEAFRTFWDRLPGREEYQYWMNLCEDGVTSVFEMGTQFSQSVEHRHLIMEKLTYTKEAESSSCKDQACGPELSSPVPIGETSTLAGAVSSASYPGAASERSAASPQESISNEIENVTEQPTPPAAEQIAEFSIQLLGKQYSEELRDPSSALYRLLVEEFISEVEKAFTGLPGYKGIHVLDFRSPKENGSGIDVHYAVTFNGEAISNTTWDLISLHSNKVENHGLVELDDKPTAVYTISNFRDYIAETLHQNFLMGNSSLNPDPKSLQLINVRGVLLPQTEEIVWNTQSSSLQVTTSSILDNTLQAEWLSADESITTTTTTTISPFGFSSGPPSATGRELHSESTLGDIVSTPKLASPSKVVLSSSPEVLGGSSLTLHSVTPAVLQIDLPVAPEGRTSGSSILEDDNTEESEDVSIDVLPSSSLIQPVPKETVPPMEDSDMILLTSSPHLTSSVIEDLAKDITTPSGLDSLASRVSDKLDVSPWFPDTSVEKEFIFESGLGSGSGKNVDVIDWPWSETSLEKTTEPLSKSWSEEQDTLLPTESIEKLHMYFTEQMIEPSAHRYGDGPIYFTEEESHVRSTIPIFAESATQPTSLISSKHTSDVPDIDSYSVTKAPFLLATIANTASTKETDEVNTLLKKGMVQTEPSSPKGLDSKISVARPDMQPVWTILPESDTVWARTSSLGKLSRDTLVSTPESADRLWLKASMTQPAELPPSTHSIQLEDEVIMAVQNISLELDQVGTDYYQPELTQEQNGKVDSYVEMPTHVHYTEMPLVAQPTKGGVLSRTQTAGALVVFFSLRVTNMLFSEDLFNKNSLEYKALEQRFLELLVPYLQSNLSGFQNLEILNFRNGSIVVNSRVKFAESVPPNVNNAIYMILEDFCTTAYQTMNLDIDKYSLDVESGDDANPCKFQACNEFSECLVNPWSGEAKCKCHPGYLSVDELPCQSVCDLQPDFCLNDGKCDVMPGHGAICRCRVGSNWWYRGQHCEEFVSEPFVIGITIASVVSLLLVASAVVFFLAKMLQAQNVRRERQRPTNRQPDSLSSVENAMKYNPAYESRLAGCEQYEKPYSQHPFYSSASEEVIGGLSREEIRQMYESSDLSKEEIQERMRILELYANDPEFAAFVREHEMEEL

SEQ ID NO: 319 - protein, 1423 aa, Gallus gallus
  Chicken Interphotoreceptor matrix proteoglycan 2 SPACRCAN Q1XI86
  VARIANT 491, 606, 623, 812, 842: Xaa = any amino acid
MFAFLWKISLCLLVLGVITGDPQAVAAEEKQAKDASPTPQLGVWQFASPSLPPELRKLHGIVEAEQVNRHLLRRRKRSILFPSGVKICPDESVEQAIANHLKYFRLRVCQETVWEVFKTFWDRLPEREEYHTWMSLCEEGTMSIFEMGMNFSQSEEHRSLIVKKLSYTKEAMAGSCTDWSCGGTPTPASDADATTLRDAAANVPPPHEVSIESPPGGTSHEIEDADTTINNEIKKEDEIPVRPVTEQMIEFSIVIAGEKYSEELSDPDTAKYQLLSEQFVSQIQNVFEGLPGYKNIHVLEFSSPEEDSGVEVHYAVTFDGEAISNATWDLINLHSNKVEDNSFMGIEDNPTVVYTISDFQDYIAEILQKNALLENTSLTLDPNSLQLINVKEILHPTQEDPSWITEHPTVLEHVEFDDNTFSAERPSADESTVSNTLPFDFTKPDSTLDSEESDDNEIRPRPESLDSEVSLIPEAPLSSEADVTSLPDGLXLADWNQTPALVTAPVIEHDSLDSLEWLSAPDSSDEFEDTGLSDDFLLPSSPSSHLVPEEPPSTDDYTAPLLSAPTVASSSVIETDTKRTVTAEKEVVTQGSPADSSSADSLLHEXVEESPFPLEVHPVEGEXDIYLGDRMIFDDGSGSAFDGSGKGMEPSIWPWDVATLEPVFYPGPDSWLDDDNDSLPFRTEDIPEGLILDYILNSGNKLDDDPSKDENEGVASIKENFLDESEIFVFPETTTQQVPLLQTGEPSSVETSTQMETLSMDDDSFVKPSFVLEPPEDYSFADLPTGEDLFLPHSTGVSVEDTLLTSTVTLGXEDSLLTSTVAFSVEQPEESSVGQEIISEAXEHQNEDRPTVEELFTAGQSNVGEAATVGYLDKSSLETVLTAEPFEVSTDTSTEEQQSLDSSLADRDTGLAIRKPADVWPTDRVLEKTLDQTVQSAVPTAAQVSTAVPSLIHQATALEGFAGQDGTEHDTHVSMSISTILNSYVTITADTVELPSHLPPMTTTVSSSVVTLAKVGDETTRVLDVSVDLDHVSMVSFSPEPSEEAKSMTDSHMELTTHAHSTEMAGVAWPTHEIHNSTPVPSRALVVFFSLRVTNMMFSEDLFNKNSPEYKALEQRFLELLVPYLQSNLTGFQNLEILNFRNGSIVVNSRMKFAKPVPRNVTNAVYMILEDFCNTAYHTMNLAIDKYSLDVESGEQADPCKFQACNEFSECLVNRWSGEAECVCNPGYLSIDGLPCNSICDLQPNFCLNDGKCDISPGQGAICRCRVGENWWYRGEHCEEYVSEPLVVGIAIASVAGFLLVASAVIFFLARTLRDQYTKSDTEDSQGQGDSLSSIENAVKYNPMYESDTTGYSHYYRRYPQLTSYSSTSAETSTDYSSEEIRHIYENSELTKEEIQDRIRIIELYAKDRQFAEFVRQHQMKLL

SEQ ID NO: 320 - protein, 304 aa, Mus musculus
  Mouse CD38 P56528
MANYEFSQVSGDRPGCRLSRKAQIGLGVGLLVLIALVVGIVVILLRPRSLLVWTGEPTTKHFSDIFLGRCLIYTQILRPEMRDQNCQEILSTFKGAFVSKNPCNITREDYAPLVKLVTQTIPCNKTLFWSKSKHLAHQYTWIQGKMFTLEDTLLGYIADDLRWCGDPSTSDMNYVSCPHWSENCPNNPITVFWKVISQKFAEDACGVVQVMLNGSLREPFYKNSTFGSVEVFSLDPNKVHKLQAWVMHDIEGASSNACSSSSLNELKMIVQKRNMIFACVDNYRPARFLQCVKNPEHPSCRLNT

SEQ ID NO: 321 - protein, 303 aa, Rattus norvegicus
  Rat CD38 Q64244
MANYEFSQVSEDRPGCRLTRKAQIGLGVGLLLLVALVVVVVIVLWPRSPLVWKGKPTTKHFADIILGRCLIYTQILRPEMRDQDCKKILSTFKRGFISKNPCNITNEDYAPLVKLVTQTIPCNKTLFWSKSKHLAHQYTWIQGKMFTLEDTLLGYIADDLRWCGDPSTSDMNYDSCPHWSENCPNNPVAVFWNVISQKFAEDACGVVQVMLNGSLSEPFYRNSTFGSVEVFNLDPNKVHKLQAWVMHDIKGTSSNACSSPSINELKSIVNKRNMIFACQDNYRPVRFLQCVKNPEHPSCRLNV

SEQ ID NO: 322 - protein, 298 aa, Oryctolagus cuniculus
  Rabbit CD38 Q0MZ03
MPDYEFSPASGDRPRSWISKQVLIVLGVCLPVILALAIWVGVLTWRQSSMGATDHVSAIVLGRCLTYTRNMHPELRNQDCKKILNTFTSAFVSKDPCNITKEDYQPLIDLVTQTVPCNKTLFWSRSKELAHQYSGIQKEMFTLEDTLLGYIADNLVWCGDPRTSEVKEEFCPYRNENCSSTATSVFWTVVSQKFAESACGTVYVMLNGSRTTAFSKASTFGSVEVFNLHPDRVHTLHAWVMHDIGGVERDSCLGSSIKELKSIVNQRNISFFCQDDYRPARFVQCVRHPEHPSCSVLM

SEQ ID NO: 323 - protein, 301 aa, Macaca fascicularis
  Cynomolgus monkey CD38 Q5VAN0
MANCEFSPVSGDKPCCRLSRRAQVCLGVCLLVLLILVVVVAVVLPRWRQQWSGSGTTSRFPETVLARCVKYTEVHPEMRHVDCQSVWDAFKGAFISKYPCNITEEDYQPLVKLGTQTVPCNKTLLWSRIKDLAHQFTQVQRDMFTLEDMLLGYLADDLTWCGEFNTFEINYQSCPDWRKDCSNNPVSVFWKTVSRRFAETACGVVHVMLNGSRSKIFDKNSTFGSVEVHNLQPEKVQALEAWVIHGGREDSRDLCQDPTIKELESIISKRNIRFFCKNIYRPDKFLQCVKNPEDSSCLSGI

SEQ ID NO: 324 - protein, 411 aa, Mus musculus
  Mouse Intracellular hyaluronan-binding protein 4 Q9JKS5
MKGALGSPVAAAGAAMQETFGCVVANRFHQLLDDESDPFDILREAEHRRQQQLQRKRRDEAAAASGAGHRGGRSPAVASGHRPGAGGRRESQKERKSLAASGAQQPDSPGGPQPPGQKRTPRRGEQQGWNDNRGTDVVLERAERRSYREYRPYETERQADLPVEKFTDEKPVDRFDRDRPLRGRGGPRGGLRSRGRGGPGNRAFDSFDQRGKRDFERYSSNDKTNRMEDSMGGCGIRPWGSGKDTSDTEPPAPMEETSMMEECQGTLDEESAAKVPELEVEEENQVQEMTLDEWKNLQEQTRPKPEFNIRKPESTVPSKAVVIHKSRYRDDMVKEDYEDESHVFRKAANDITSQLEINFGNLPRPGRGARGSTRGGRGRMRRTENYGPRAEVVTQDVAPNPDDPEDFPALA

SEQ ID NO: 325 - protein, 357 aa, Gallus gallus
  Chicken Intracellular hyaluronan-binding protein 4 Q9I9R0
MMKGAMGCPVAAVMEGSFSCTVANRFYQLLDDESDPFDNLREAERCWQQRKNLSKVVARRGDPGSRGCATRRELQKQRKQLGTPAPPPQPGQKQAPKQEECGGKDNSRAEKEHKTAWRPSFMEYLSSETESQAELTAQSLFRPTAKLNYERPRGCGRGRGGMQGRGRGGGINKSFDGFDQRGKREFGRQNDNDKIEMELTAPMEATAKTAKSPGVSEGELLNKVAEGKPREEVVQEMTLDEWKNLQQQNRPKHEFNIRRPESTVPSKAVVIHKSKYSDDIQKGELEDDYHIFRRAVNDITFQLDINFGSLPRPGCGSRGARGRGRGRQMEETGPQPEAMVQIVAPNPDDPEDFPALT

SEQ ID NO: 326 - protein, 506 aa, Saccharomyces cerevisiae
  Saccharomyces cerevisiae Baker's yeast CDC37 P06101
MAIDYSKWDKIELSDDSDVEVHPNVDKKSFIKWKQQSIHEQRFKRNQDIKNLETQVDMYSHLNKRVDRILSNLPESSLTDLPAVTKFLNANFDKMEKSKGENVDPEIATYNEMVEDLFEQLAKDLDKEGKDSKSPSLIRDAILKHRAKIDSVTVEAKKKLDELYKEKNAHISSEDIHTGFDSSFMNKQKGGAKPLEATPSEALSSAAESNILNKLAKSSVPQTFIDFKDDPMKLAKETEEFGKISINEYSKSQKFLLEHLPIISEQQKDALMMKAFEYQLHGDDKMTLQVIHQSELMAYIKEIYDMKKIPYLNPMELSNVINMFFEKVIFNKDKPMGKESFLRSVQEKFLHIQKRSKILQQEEMDESNAEGVETIQLKSLDDSTELEVNLPDFNSKDPEEMKKVKVFKTLIPEKMQEAIMTKNLDNINKVFEDIPIEEAEKLLEVFNDIDIIGIKAILENEKDFQSLKDQYEQDHEDATMENLSLNDRDGGGDNHEEVKHTADTVD

SEQ ID NO: 327 - protein, 389 aa, Drosophila melanogaster
  Fruit fly CDC37 Q24276
MVDYSKWKNIEISDDEDDTHPNIDTPSLFRWRHQARVERMAEMDHEKDELKKKRQSYQARLMDVKERISKKDGDEEALKKELEKIEAEGKELDRIESEMIKKEKKTPWNVDTISKPGFEKTVINKKAGRKPDENLSEEEREQRMKQFVKENEKLCQQYGMLRKYDDSKRFLQEHLHLVGEETANYLVIWSINLEMEEKHELMAHVAHQCICMQYILELAKQLDVDPRACVSSFFSKIQHCHPEYRAQFDSEIEGFKGRIQKRAQEKIQEAIAQAEEEERKERLGPGGLDPADVFESLPDELKACFESRDVELLQKTIAAMPVDVAKLHMKRCVDSGLWVPNAADLEGDKKEEDDSDDVAGGEEKTDDAKSESAAKEEPIYTGVSTEDVD

SEQ ID NO: 328 - protein, 379 aa, Rattus norvegicus
  Rat CDC37 Q63692
MVDYSVWDHIEVSDDEDETHPNIDTASLFRWRHQARVERMEQFQKEKEELDRGCRECKRKVAECQRKLKELEVAEGGGQVELERLRAEAQQLRKEERSWEQKLEDMRKKEKNMPWNVDTLSKDGFSKSMVNTKPEKAEEDSEEAREQKHKTFVEKYEKQIKHFGMLHRWDDSQKYLSDNVHLVCEETANYLVIWCIDLEVEEKCALMEQVAHQTMVMQFILELAKSLKVDPRACFRQFFTKIKTADQQYMEGFKYELEAFKERVRGRAKLRIEKAMKEYEEEERKKRLGPGGLDPVEVYESLPEELQKCFDVKDVQMLQDAISKMDPTDAKYHMQRCIDSGLWVPNSKSGEAKEGEEAGPGDPLLEAVPKAGNEKDISA

SEQ ID NO: 329 - protein, 379 aa, Mus musculus
  Mouse CDC37 Q61081
MVDYSVWDHIEVSDDEDETHPNIDTASLFRWRHQARVERMEQFQKEKEELDRGCRECKRKVAECQRKLKELEVAESDGQVELERLRAEAQQLRKEERSWEQKLEDMRKKEKNMPWNVDTLSKDGFSKSMVNTKPEKAEEDSEEAREQKHKTFVEKYEKQIKHFGMLHRWDDSQKYLSDNVHLVCEETANYLVIWCIDLEVEEKCALMEQVAHQTMVMQFILELAKSLKVDPRACFRQFFTKIKTADHQYMEGFKYELEAFKERVRGRAKLRIEKAMKEYEEEERKKRLGPGGLDPVEVYESLPEELQKCFDVKDVQMLQDAISKMDPTDAKYHMQRCIDSGLWVPNSKSGEAKEGEEAGPGDPLLEAVPKAGNEKDVSA

SEQ ID NO: 330 - protein, 466 aa, Schizosaccharomyces pombe
  Fission yeast CDC37 O94740
MAIDYSKWDKLELSDDSDIEVHPNVDKKSFIRWRQRDIHEKRAVRKQKMEDIKGAMAMNRRLLSRISEMETVLEKESPSDPYVLLGSFLEAKKSEDMDSAIPGGMSYHHMLMSLLKVIKDAEDTTEEKSMDDSDKCLRRLKSHKERLLKLLEDAQKEYDTLEAESKNYITSEDLHLGFDSTYVQKKEPEKPKKTKTKKETIQVIESLNNPTPPTDFPGAKEQASTGNAPKNPVNENESEDEEGLSLSEDGKKFANIDFGDYSSSEEFLKEHLNILADEEESDAILLEAFNAELEGKPSLAKQYVHQALLISYCRQLGPNGLSIFFQKIKDPNHQSQRLFLEDVHNTYVRIHERSAAISKEQAESGEGVEQIQLCAVDPNTKLSITIPEAGSTDPETQKARAAFESFPPNLQKALMTNDLDKINVVLGKMAVENAEEVVEKLSSTGMLSIEEGIIDTTKGETIPQLS

SEQ ID NO: 331 - protein, 399 aa, Drosophila virilis
  Drosophila virilis Fruit fly CDC37 Q24740
MVDYSKWKNIEISDDEDETHPNIDTPSLFRWRHQARVERMAESEKEKEELKKKRQSYQARLINVKELISKKEGDEVALKKELEKIENEGKELDRQENELLKREKKTPWNVDTISKPGFEKTVINKKPPRKAAEDLTEEEREQRMKQFVKENEKLCKQYGMLRKYDDSKRFLQEHLDLVCEETANYLVIWSINLEMEEKHDLMAHVAHQCICMQYILELAKQLDVDPRACVSSFFSKIQQCVPEYRQQFESEIEGFKERIQKRAQEKLQEAMAQLEEEEKQERMGPGGLDPADVFESLPEELKACFESRDIELLQKTIATMPVDQAKYHMKRCVDSGLWVPNAADVQLGNDETEAKDDETTTATNETPTEKENSKSQNEKSADAAKEEPLYAGVSTDDVD

SEQ ID NO: 332 - protein, 393 aa, Gallus gallus
  Chicken CDC37 Q57476
MVDYSVWDHIEVSDDEDETHPNIDTASLFRWRHQARVERMEQFQKEKEELDKGCRECKRKLAECQKKLKELEVAEPGGGSGGGRGERERLQAEAQQLRHEERNWESKMEELRKKEKNMPWNVHTLSKDGFSKSVFNVKAEEKEETEEQKEQKHKTFVERHEKQIKHFGMLRRWDDSQKYLSDNPHLVCEETANYLVIWCIDLEVEEKQALMEQVAHQTIVMQFILELAKSLKVDPRACFRQFFTKIKTADQQYMEGFNDELEAFKERVRGRAKARIERAMREYEEEERQKRLGPGGLDPVDVYESLPPELQKCFDAKDVQMLQDTISRMDPTEAKYHMQRCIDSGLWVPNAKAAAEGGGQGGAHGQPGGADSEALYEEIPKESGEEEGGEGKA

SEQ ID NO: 333 - protein, 380 aa, Bos taurus
  Cow CDC37 Q5EAC6
MVDYSVWDHIEVSDDEDETHPNIDTASLFRWRHQARVERMEQFQKEKEELDRGCRECKRKVAECQRKLKELEVAEGEGGKAELERLQAEAQQLRKEERSWEQKLEEMRKKEKSMPWNVDTLSKDGFSKSMVNTKPEQAEEESEEVREQKHKTFVEKYEKQIKHFGMLRRWDDSQKYLSDNVHLVCEETANYLVIWCIDLEVEEKCALMEQVAHQTIVMQFILELAKSLKVDPRACFRQFFTKIKTADRQYMEGFNDELEAFKDRVRGRAKLRIEKAMKEYEEEERKKRLGPGGLDPVEVYESLPEELQKCFDAKDVQMLQDAISKMDPTDAKYHMQRCIDSGLWVPNSKSSEAKDGEEAGTGDPLLEATSKSGDEKDVSV

SEQ ID NO: 334 - protein, 508 aa, Candida albicans
  Candida albicans Yeast CDC37 Q8X1E6
MPIDYSKWDKIEISDDSDVEVHPNVDKQSFIRWKQRDIHEKRMQRNIEIKSILIQLTMYAKLNERVDYLLEKLTSTELLDSEKVMSKLNSEFDPQEKFDYDKLIKDKGSTLRKGLKDLKFDREEIENTPCYNEMIEDLFVQIKDDHPETKTDGDKLIEYLKEHRNRIDDVLSKQTIKLDDLLYQKAQLIVSDDLHTGFDRSFLNKDKPEEKEENQDKPKAPEAKKTTVTTTETINSPKPVEENTDKEILDELEILPATKEFAKIPSDNLSKAAEFLIKHPSICTEQQKDALIMTAFDLQLENKSDEAKHIVHQSLLLQYVGQLSDNGKAAPANVINAIKLFFSKIAAESSPAKHAFLEDVNQTFNHIKGRCEIIKEEQKQNAANKEGTGEEEEEEALIQLKALDDNTELSVNIPQEGTKEYEIFTTKLPIEFQNAIKTESIDEVNKEFAKLKIEDAERILEIFNECGVIGISGYIEDEKEFEELKKEYAHETANQEEDQSASVEDTVD

SEQ ID NO: 335 - protein, 370 aa, Caenorhabditis elegans
  Caenorhabditis elegans CDC37 O02108
MPIDYSKWKDIEVSDDEDDTHPNIDTPSLFRWRHQARLERMAEKKMEQEKIDKEKGTTSKKMEELEKKLAAADVTDKSDIQKQIDEVKAQEEAWRKKEAELEEKERLEPWNVDTIGHEAFSTSRINKITEKKPQAPKTDEEDTHAMSTFFETHESLLEKMAVLKNGAKSTELFLAEHPHMASEYTANWLTIEALNAAIDFNEEKMKTMAEQCIIIQYLLELSKSLNAVATNTTVQKQFFKKFEAAEPVYMKHYQDEVKAFEDRLRTRAQTKRDAAMEEAEAEEKAERMKSAPGGIDPQEVFEQLPEEMRKCFEAHDIEALKGVAQKMDEEVFKYHFDRCIASGLWVPGKADDDDDDEEAAPAEEEPTTSS

SEQ ID NO: 336 - protein, 377 aa, Tetraodon fluviatilis
  Tetraodon fluviatilis Green pufferfish CDC37 Q9DGQ7
MSRIDYSVWDHIEVSDDEDVSHPNIDTPSLFRWRHQARVERMEDFKKKGDDLNKGLQECRRKLAEAQKKVRELSISAAGDAKAELTKTQTEEKKLKKEERDWARKLEEHNHEEKKMPWNVDTLSKDGFSKSIVNVKADSAEDTEEEKEKKHKTFVERYEKQIKHFGMLHRWDDSQRYLSDNPDLVCEETANYLVIMCIDLEVEEKHALMEQVAHQTIVMQFILELAKSLKVDPRGCFRQFFEKIKTADQQYQDAFNDELESFKERVRGRAKIRIEKAMKEYEEEERQKRLGPGGLDPVEVYESLPPEMQKCFDEKDIQMLQDVITKMDPTEAKAHMKRCIDSGLWVPNSKMDESDEKEDGSTYEEVKQEQEEPAKKE

SEQ ID NO: 337 - protein, 558 aa, Mus musculus
  Mouse Hyaluronan-binding protein 2 Q8K0D2
MFVRMLVFRVLLLIALVGKSVIGLSLMSFIAPPDPDWTPDDYYYSYEQSSPDEDPSVTQTTPENPDWYYEDDDPCQSNPCEHGGDCIIRGDTFSCSCPAPFSGSRCQTAQNKCKDNPCVHGDCLITQKHPYYRCACKYPYTGPDCSKVLPACRPNPCQNGGVCSRHRRRSRFTCACPDQYKGKFCEIGPDDCYVGDGYSYRGKVSKTVNQNPCLYWNSHLLLQETYNMFMEDAETHGIAEHNFCRNPDGDHKPWCFVKVNSEKVKWEYCDVTVCPVPDTPNPVESLLEPVMELPGFESCGKTEVAEHAVKRIYGGFKSTAGKHPWQVSLQTSLPLTTSMPQGHFCGGALIHPCWVLTAAHCTDINTKHLKVVLGDQDLKKTESHEQTFRVEKILKYSQYNERDEIPHNDIALLKLKPVGGHCALESRYVKTVCLPSDPFPSGTECHISGWGVTETGEGSRQLLDAKVKLIANPLCNSRQLYDHTIDDSMICAGNLQKPGSDTCQGDSGGPLTCEKDGTYYVYGIVSWGQECGKKPGVYTQVTKFLNWIKTTMHREAGL

SEQ ID NO: 338 - protein, 558 aa, Rattus norvegicus
  Rat Hyaluronan-binding protein 2 Q6L711
MSVVMLVFRVLLLIALVGNSAIGLSLMPFIAPPDPDWTPDDYYYSYEQSSPDKDASVTQTSPENPDWYYEDDDPCQSNPCEHGGDCIIRGNTFSCSCPAPFSGSRCQTVQNKCKDNPCVQGDCLITQTPPYYRCACKYPYTGPDCSKVLPVCRPNPCQNGGVCSRHRRRSRFSCACPDQYKGRFCEIGPDDCYVGDGYSYRGKVSRTVNQNPCLYWNSHLLLQENYNMFMEDAETHGIADHNFCRNPDGDHKPWCFVKVNSEKVKWEYCNVEVCPESDAANPVGSLQEPVMELPGFDSCGKTEMTEHAVKRIYGGFKSTAGKHPWQVSLQTSLPLTTSMPQGHFCGGSLIHPCWVLTAAHCTDMSTKHLKVVLGDQDLKKTESHEQTFRVEKILKYSQYNERDEIPHNDIALLKLKPVGGHCALESKYVKTVCLPSDPFPSGTECHISGWGVTETGEGSRQLLDAKVKLIANALCNSRQLYDHTIDDSMICAGNLQKPGSDTCQGDSGGPLTCEKDGTYYVYGIVSWGQECGKKPGVYTQVTKFLNWIKTTMHKEAGL

SEQ ID NO: 339 - protein, 558 aa, Bos taurus
  Cow Hyaluronan-binding protein 2 Q5E9Z2
MFARMSDLHVLLLMVLAGKTAFGLSLLSFLTEPDPDWTPDQYEYSQEYNNQEENASSTTAYSDNPDWYYEEDDPCLSNPCTHGGDCLVSGATFTCRCPDPFSGNRCQNVQNKCKNNPCGRGDCLITQSPPYHRCACKHPYRGSDCSRVVPVCRPNPCQNGGTCSRQRRRSKFTCACPDQFKGKLCEIGPDDCYVDDGYSYRGRVSKTIHQHTCLYWNSHLLLQEKYNMFMEDAEAHGIGEHNFCRNPDGDKKPWCFIKVNNVKVKWEYCDVPACSALDVANPEGRPTEPLTKFPEFGSCGRTEIAEKKVKRIFGGFKSTAGKHPWQASLQTSLRLTVSTPQGHYCGGALIHPCWVLTAAHCTEIKTKYLKVVLGDQDLTKTEFHEQSFGVQKIFKYSHYIEIDDIPYNDIALLKLKPVDGHCALESKYVKTVCLPDGPFLSGTECYISGWGVTETGEGSRHLLDAKVKLISNTICNSRQLYDHSIDDNMICAGNLQKPGQDSCQGDSGGPLTCEKDGTSYIYGIVSWGLECGKRPGVYTQVTKFLTWIKATMEKEASF

SEQ ID NO: 340 - protein, 2315 aa, Homo sapiens
  human Phosphacan NP_002842
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNGETPLQPSYSSEVFPLVTPLLLDNQILNTTPAASSSDSALHATPVFPSVDVSFESILSSYDGAPLLPFSSASFSSELFRHLHTVSQILPQVTSATESDKVPLHASLPVAGGDLLLEPSLAQYSDVLSTTHAASETLEFGSESGVLYKTLMFSQVEPPSSDAMMHARSSGPEPSYALSDNEGSQHIFTVSYSSAIPVHDSVGVTYQGSLFSGPSHIPIPKSSLITPTASLLQPTHALSGDGEWSGASSDSEFLLPDTDGLTALNISSPVSVAEFTYTTSVFGDDNKALSKSEIIYGNETELQIPSFNEMVYPSESTVMPNMYDNVNKLNASLQETSVSISSTKGMFPGSLAHTTTKVFDHEISQVPENNFSVQPTHTVSQASGDTSLKPVLSANSEPASSDPASSEMLSPSTQLLFYETSASFSTEVLLQPSFQASDVDTLLKTVLPAVPSDPILVETPKVDKISSTMLHLIVSNSASSENMLHSTSVPVFDVSPTSHMHSASLQGLTISYASEKYEPVLLKSESSHQVVPSLYSNDELFQTANLEINQAHPPKGRHVFATPVLSIDEPLNTLINKLIHSDEILTSTKSSVTGKVFAGIPTVASDTFVSTDHSVPIGNGHVAITAVSPHRDGSVTSTKLLFPSKATSELSHSAKSDAGLVGGGEDGDTDDDGDDDDDDRGSDGLSIHKCMSCSSYRESQEKVMNDSDTHENSLMDQNNPISYSLSENSEEDNRVTSVSSDSQTGMDRSPGKSPSANGLSQKHNDGKEENDIQTGSALLPLSPESKAWAVLTSDEESGSGQGTSDSLNENETSTDFSFADTNEKDADGILAAGDSEITPGFPQSPTSSVTSENSEVFHVSEAEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFETLKEFYQEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 341 - protein, 159 aa, Homo sapiens
  CD44 Hyaluronan-binding domain
AQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDV

SEQ ID NO: 342 - protein, 5 aa, Artificial Sequence
  linker
GGGGG

SEQ ID NO: 343 - protein, 5 aa, Artificial Sequence
  linker
GGGGS

SEQ ID NO: 344 - protein, 5 aa, Artificial Sequence
  linker
SSSSG

SEQ ID NO: 345 - protein, 12 aa, Artificial Sequence
  linker
GKSSGSGSESKS

SEQ ID NO: 346 - protein, 15 aa, Artificial Sequence
  linker
GGSTSGSGKSSEGKG

SEQ ID NO: 347 - protein, 19 aa, Artificial Sequence
  linker
GSTSGSGKSSSEGSGSTKG

SEQ ID NO: 348 - protein, 18 aa, Artificial Sequence
  linker
GSTSGSGKPGSGEGSTKG

SEQ ID NO: 349 - protein, 14 aa, Artificial Sequence
  linker
EGKSSGSGSESKEF

SEQ ID NO: 350 - protein, 4 aa, Artificial Sequence
  linker
AAPA

SEQ ID NO: 351 - DNA, 27 bp, Artificial Sequence
  Gly4Ser with NcoI ends
ccatgggcggcggcggctctgccatgg

SEQ ID NO: 352 - DNA, 42 bp, Artificial Sequence
  (Gly4Ser)2  with NcoI ends
ccatgggcggcggcggctctggcggcggcggctctgccatgg

SEQ ID NO: 353 - DNA, 75 bp, Artificial Sequence
  (Ser4Gly)4 with NcoI ends
ccatggcctcgtcgtcgtcgggctcgtcgtcgtcgggctcgtcgtcgtcgggctcgtcgtcgtcgggcgccatgg

SEQ ID NO: 354 - DNA, 45 bp, Artificial Sequence
  (Ser4Gly)2  with NcoI ends
ccatggcctcgtcgtcgtcgggctcgtcgtcgtcgggcgccatgg

SEQ ID NO: 355 - protein, 330 aa, Homo sapiens [sequence omitted]

SEQ ID NO: 356 - protein, 326 aa, Homo sapiens
  hIgG2 heavy chain constant
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 357 - protein, 377 aa, Homo sapiens
  hIgG3 heavy chain constant
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 358 - protein, 327 aa, Homo sapiens
  hIgG4 heavy chain constant
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 359 - protein, 231 aa, Artificial Sequence
  hIgG1 Fc
PKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 360 - protein, 93 aa, Homo sapiens
  TSG-6 Link domain
GVYHREARSGKYKLTYAEAKAVCEFEGGHLATYKQLEAARKIGFHVCAAGWMAKGRVGYPIVKPGPNCGFGKTGIIDYGIRLNRSERWDAYCY

SEQ ID NO: 361 - protein, 93 aa, Homo sapiens
  TSG-6 Link domain variant K20A/K34A/K41A
GVYHREARSGKYKLTYAEAAAVCEFEGGHLATYAQLEAARAIGFHVCAAGWMAKGRVGYPIVKPGPNCGFGKTGIIDYGIRLNRSERWDAYCY

SEQ ID NO: 362 - protein, 39 aa, Artificial Sequence
  c-jun leucine zipper
RIARLEEKVKTLKAQNSELASTANMLREQVAQLKQKVMN

SEQ ID NO: 363 - protein, 39 aa, Artificial Sequence
  c-fos leucine zipper
LTDTLQAETDQLEDEKSALQTEIANLLKEKEKLEFILAA

SEQ ID NO: 364 - protein, 33 aa, Artificial Sequence
  GCN4 leucine zipper
RMKQLEDKVEELLSKNYHLENEVARLKKLVGER

SEQ ID NO: 365 - protein, 33 aa, Artificial Sequence
  GCN4 leucine zipper- trimer
RMKQIEDKIEEILSKIYHIENEIARIKKLIGER

SEQ ID NO: 366 - protein, 33 aa, Artificial Sequence
  GCN4 leucine zipper- tetramer
RMKQIEDKLEEILSKLYHIENELARIKKLLGER

SEQ ID NO: 367 - protein, 44 aa, Artificial Sequence
  R subunit of protein kinase A (PKA)
SHIQIPPGLTELLQGYTVEVLRQQPPDLVEFAVEYFTRLREARA

SEQ ID NO: 368 - protein, 17 aa, Artificial Sequence
  AD subunit
QIEYLAKQIVDNAIQQA

SEQ ID NO: 369 - protein, 45 aa, Artificial Sequence
  modified R subunit of protein kinase A (PKA)
CSHIQIPPGLTELLQGYTVEVLRQQPPDLVEFAVEYFTRLREARA

SEQ ID NO: 370 - protein, 21 aa, Artificial Sequence
  modified AD subunit
CGQIEYLAKQIVDNAIQQAGC

SEQ ID NO: 371 - protein, 93 aa, Homo sapiens
  Stabilin-1 Link domain
GVFHLQATSGPYGLNFSEAEAACEAQGAVLASFPQLSAAQQLGFHLCLMGWLANGSTAHPVVFPVADCGNGRVGIVSLGARKNLSERWDAYCF

SEQ ID NO: 372 - protein, 93 aa, Homo sapiens
  Stabilin-2 Link domain
GVFHLRSPLGQYKLTFDKAREACANEAATMATYNQLSYAQKAKYHLCSAGWLETGRVAYPTAFASQNCGSGVVGIVDYGPRPNKSEMWDVFCY

SEQ ID NO: 373 - protein, 93 aa, Homo sapiens; identical to SEQ ID NO: 372
  CAB61358 Link domain

SEQ ID NO: 374 - protein, 95 aa, Homo sapiens
  KIAA0527 Link domain
KLFVLESQNGSQGLQLEAARLSCKSRGAHLASADELRRVVQDCSFAVCTTGWLADGTLGTTVCSKGSGEQQIMRAVDVRIESNPVPGGTYSALCI

SEQ ID NO: 375 - protein, 88 aa, Homo sapiens
  CD44 Link domain
GVFHVEKNGRYSISRTEAADLCKAFNSTLPTMAQMEKALSIGFETCRYGFIEGHVVIPRIHPNSICAANNTGVYILTSNTSQYDTYCF

SEQ ID NO: 376 - protein, 90 aa, Homo sapiens
  LYVE-1 Link domain
GITLVSKKANQQLNFTEAKEACRLLGLSLAGKDQVETALKASFETCSYGWVGDGFVVISRISPNPKCGKNGVGVLIWKVPVSRQFAAYCY

SEQ ID NO: 377 - protein, 95 aa, Homo sapiens
  HAPLN1 Link domain 1
VVFPYFPRLGRYNLNFHEAQQACLDQDAVIASFDQLYDAWRGGLDWCNAGWLSDGSVQYPITKPREPCGGQNTVPGVRNYGFWDKDKSRYDVFCF

SEQ ID NO: 378 - protein, 92 aa, Homo sapiens
  HAPLN1 Link domain 2
GRFYYLIHPTKLTYDEAVQACLNDGAQIAKVGQIFAAWKILGYDRCDAGWLADGSVRYPISRPRRRCSPTEAAVRFVGFPDKKHKLYGVYCF

SEQ ID NO: 379 - protein, 94 aa, Homo sapiens
  HAPLN2 Link domain 1
VVFPYQPSRGRYQFNYYEAKQACEEQDGRLATYSQLYQAWTEGLDWCNAGWLLEGSVRYPVLTARAPCGGRGRPGIRSYGPRDRMRDRYDAFCF

SEQ ID NO: 380 - protein, 90 aa, Homo sapiens
  HAPLN2 Link domain 2
GQFFVPGRLTLSEAHAACRRRGAVVAKVGHLYAAWKFSGLDQCDGGWLADGSVRFPITTPRPRCGGLPDPGVRSFGFPRPQQAAYGTYCY

SEQ ID NO: 381 - protein, 95 aa, Homo sapiens
  APLN3 Link domain 1
VVFPYQSPNGRYQFNFHEGQQVCAEQAAVVASFEQLFRAWEEGLDWCNAGWLQDATVQYPIMLPRQPCGGPGLAPGVRSYGPRHRRLHRYDVFCF

SEQ ID NO: 382 - protein, 92 aa, Homo sapiens
  HAPLN3 Link domain 2
GRVYYLEHPEKLTLTEAREACQEDDATIAKVGQLFAAWKFHGLDRCDAGWLADGSVRYPVVHPHPNCGPPEPGVRSFGFPDPQSRLYGVYCY

SEQ ID NO: 383 - protein, 105 aa, Homo sapiens
  HAPLN4 Link domain 1
VVFPYHPRGGRYKLTFAEAQRACAEQDGILASAEQLHAAWRDGLDWCNAGWLRDGSVQYPVNRPREPCGGLGGTGSAGGGGDANGGLRNYGYRHNAEERYDAFCF

SEQ ID NO: 384 - protein, 92 aa, Homo sapiens
  HAPLN4 Link domain 2
GRVFFLKPLRPVPFSGAARACAARGAAVAKVGQLFAAWKLQLLDRCTAGWLADGSARYPIVNPRARCGGRRPGVRSLGFPDATRRLFGVYCY

SEQ ID NO: 385 - protein, 95 aa, Homo sapiens
  Aggrecan Link domain 1
IVFHYRAISTRYTLDFDRAQRACLQNSAIIATPEQLQAAYEDGFHQCDAGWLADQTVRYPIHTPREGCYGDKDEFPGVRTYGIRDTNETYDVYCF

SEQ ID NO: 386 - protein, 96 aa, Homo sapiens
  Aggrecan Link domain 2
EVFYATSPEKFTFQEAANECRRLGARLATTGQLYLAWQAGMDMCSAGWLADRSVRYPISKARPNCGGNLLGVRTVYVHANQTGYPDPSSRYDAICY

SEQ ID NO: 387 - protein, 95 aa, Homo sapiens
  Aggrecan Link domain 3
VVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCF

SEQ ID NO: 388 - protein, 96 aa, Homo sapiens
  Aggrecan Link domain 4
EVFFATRLEQFTFQEALEFCESHNATLATTGQLYAAWSRGLDKCYAGWLADGSLRYPIVTPRPACGGDKPGVRTVYLYPNQTGLPDPLSRHHAFCF

SEQ ID NO: 389 - protein, 95 aa, Homo sapiens
  Brevican Link domain 1
VVFLYREGSARYAFSFSGAQEACARIGAHIATPEQLYAAYLGGYEQCDAGWLSDQTVRYPIQTPREACYGDMDGFPGVRNYGVVDPDDLYDVYCY

SEQ ID NO: 390 - protein, 96 aa, Homo sapiens
  Brevican Link domain 2
ELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCF

SEQ ID NO: 391 - protein, 95 aa, Homo sapiens
  Versican Link domain 1
VVFHYRAATSRYTLNFEAAQKACLDVGAVIATPEQLFAAYEDGFEQCDAGWLADQTVRYPIRAPRVGCYGDKMGKAGVRTYGFRSPQETYDVYCY

SEQ ID NO: 392 - protein, 96 aa, Homo sapiens
  Versican Link domain 2
DVFHLTVPSKFTFEEAAKECENQDARLATVGELQAAWRNGFDQCDYGWLSDASVRHPVTVARAQCGGGLLGVRTLYRFENQTGFPPPDSRFDAYCF

SEQ ID NO: 393 - protein, 95 aa, Homo sapiens
  Neurocan Link domain 1
VVFHYRSARDRYALTFAEAQEACRLSSAIIAAPRHLQAAFEDGFDNCDAGWLSDRTVRYPITQSRPGCYGDRSSLPGVRSYGRRNPQELYDVYCF

SEQ ID NO: 394 - protein, 96 aa, Homo sapiens
  Neurocan Link domain 2
EVFYVGPARRLTLAGARAQCRRQGAALASVGQLHLAWHEGLDQCDPGWLADGSVRYPIQTPRRRCGGPAPGVRTVYRFANRTGFPSPAERFDAYCF

SEQ ID NO: 395 - DNA, 20 bp, Artificial Sequence
  HAS1 Forward primer
tacaaccagaagttcctggg

SEQ ID NO: 396 - DNA, 20 bp, Artificial Sequence
  HAS1 Reverse primer
ctggaggtgtacttggtagc

SEQ ID NO: 397 - DNA, 21 bp, Artificial Sequence
  HAS2 forward primer
gtatcagtttggtttacaatc

SEQ ID NO: 398 - DNA, 21 bp, Artificial Sequence
  HAS2 reverse primer
gcaccatgtcatattgttgtc

SEQ ID NO: 399 - DNA, 20 bp, Artificial Sequence
  HAS3 forward primer
cttaagggttgcttgcttgc

SEQ ID NO: 400 - DNA, 20 bp, Artificial Sequence
  HAS3 reverse primer
gttcgtgggagatgaaggaa

SEQ ID NO: 401 - DNA, 20 bp, Artificial Sequence
  HYAL1 forward primer
gtgctgccctatgtccagat

SEQ ID NO: 402 - DNA, 20 bp, Artificial Sequence
  HYAL1 reverse primer
attttcccagctcacccaga

SEQ ID NO: 403 - DNA, 19 bp, Artificial Sequence
  HYAL2 forward primer
tctaccattggcgagagtg

SEQ ID NO: 404 - DNA, 18 bp, Artificial Sequence
  HYAL2 reverse primer
gcagccgtgtcaggtaat

SEQ ID NO: 405 - DNA, 20 bp, Artificial Sequence
  GAPDH forward primer
tgcaccaccaactgcttagc

SEQ ID NO: 406 - DNA, 21 bp, Artificial Sequence
  GAPDH reverse primer
ggcatggactgtggtcatgag

SEQ ID NO: 407 - protein, 277 aa, Homo sapiens [sequence omitted]

SEQ ID NO: 408 - protein, 277 aa, Pan troglodytes
  chimpanzee TSG-6 protein
MIILIYLFLLLWEDTQGWGFKDGIFHNSIWLERAAGVYHREARSGKYKLTYAEAKAVCEFEGGHLATYKQLEAARKIGFHVCAAGWMAKGRVGYPIVKPGPNCGFGKTGIIDYGVRLNRSERWDAYCYNPHAKECGGVFTDPKRIFKSPGFPNEYEDNQICYWHIRLKYGQRIHLSFLDFDLEDDPGCLADYVEIYDSYDDVHGFVGRYCGDELPDDIISTGNVMTLKFLSDASVTAGGFQIKYVAMDPVSKSSQGKNTSTTSTGNKNFLAGRFSHL

SEQ ID NO: 409 - protein, 277 aa, Equus caballus
  horse TSG-6 protein
MIILIYVLVLLWEEAHGWGFKNGIFHNSIWLEQAAGVYHREARSGKYKLTYAEAKAVCEYEGGHLATYKQLEAARKIGFHVCAAGWMAKGRVGYPIVKPGPNCGFGKTGIIDYGIRLNRSERWDAYCYNPHAKECGGIFTDTKRIFKSPGFPNEYDDNQVCYWHIRLKYGQRIHLSFLDFDLEDDTGCLADYVEIYDSYDDVHGFVGRYCGDELPEDIISTGNVMTLKFLSDASVTAGGFQIKYVAVDPPSKPSQGKNTSTTSTGNKSFLAPSFTHL

SEQ ID NO: 410 - protein, 277 aa, Canis lupis
  dog TSG-6 protein
MIIFISLFVLLWEEAHGWGFNNGIFHNSIWLEQAAGVYHREARSGRYRLTYAEAKAVCEFEGGRLATYKQLEAARKIGFHVCAAGWMAKGRVGYPIVKPGPNCGFGKTGIIDYGVRLNRSERWDAYCYNPHAKECGGVFTDPKRIFKSPGFPNEYDDNQICYWHIRVKYGQRVHLSFLDFDLEDDPACLADYVEIYDSYDDVHGFVGRYCGDELPEDIISTGNVMTLKFLSDASVTAGGFQIKYIAVDPLSKSSQGKNTSTTSTGNKNFLAGRFSHL

SEQ ID NO: 411 - protein, 275 aa, Mus musculus; identical to SEQ ID NO: 252
  mouse TSG-6 protein

SEQ ID NO: 412 - protein, 275 aa, Gallus gallus
  chicken TSG-6 protein
MIALIFFSALLWDEAQAWGFKDGVLHNSIWLERAAGVYHRESRSGKYQLTYAEAKAVCEYEGGHLATYQQLEAARKIGFHVCAAGWMAKGRVGYPIVKAGANCGFGRTGIVDYGIRLNRSERWDAYCYNPNGKECGGVFTDSKHVFKSPGYPNEYENDQICYWHIRVKYGQRIHLQFLEFDVEDDTACMADYLEIYDSYDDINGFVGRFCGDELPDDIISTGNVMTLKFLSDASVTAGGFQIRYVTIDLPSKAGDGKNTTSQGKANFLSGKFGIM

SEQ ID NO: 413 - protein, 266 aa, Xenopus laevis
  African clawed frog TSG-6 protein
MKTMIFLVLVFLDETFGWGFKNGVLHNSIWLEQAAGVYHRESRNGKYKLTYREAKAVCEYEGGRLATYEQLEAARQIGFHVCAAGWLHKGRVGYPIVKPTFNCGFGKKGIIDYGFRLNKSERWDAYCYNPHAKECGGVLTEQERIIKSPGYPDHYENDQICYWHIRVNYGQRIFIEFLDLDIEEDIDCLSDYFEIYDSYDDLHGLVGRYCGYELPDRIISTGNVMTLKFLSDGSVIGGGFQIKYTAVDSERNETNASSEPYNEFEY

SEQ ID NO: 414 - protein, 271 aa, Danio rerio
  zebrafish TSG-6 protein
MSHCGLRAMRALTAVFGVLIVLKETEAWGYKNGILHNSIWLEQAAGVYHRESRKGRYQLTYKEAKAVCNFEGGTLATFDQLEAARQIGFHVCAAGWLDKGRVGYPIVKAGSNCGFGKVGIIDYGYRLNKSERWDVYCYNPVAKECGGVHTDPEKVLVSPGYPDEYQDEQICYWHIRVRFGHRIRLHFLDFDIEEDTDCLSDHLEIYDSYDDVSGFVGRYCGDQLPDDFISTGNVMTLKFLSDSSVTAGGFKLQYISVNSSQLFDLLADSFS

SEQ ID NO: 415 - protein, 14 aa, Artificial Sequence
  V5 tag
GKPIPNPLLGLDST

SEQ ID NO: 416 - protein, 95 aa, Homo sapiens
  TSG-6 link domain aa 35-129 variant K21A/K35A/K42A
AGVYHREARSGKYKLTYAEAAAVCEFEGGHLATYAQLEAARAIGFHVCAAGWMAKGRVGYPIVKPGPNCGFGKTGIIDYGIRLNRSERWDAYCYN

SEQ ID NO: 417 - protein, 94 aa, Homo sapeins
  TSG-6 link domain aa 36-129
GVYHREARSGKYKLTYAEAKAVCEFEGGHLATYKQLEAARKIGFHVCAAGWMAKGRVGYPIVKPGPNCGFGKTGIIDYGIRLNRSERWDAYCYN

SEQ ID NO: 418 - protein, 97 aa, Homo sapiens
  TSG-6 link domain aa 36-132
GVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHA

SEQ ID NO: 419 - protein, 10 aa, Artificial Sequence
  c-myc Tag
EQKLISEEDL

SEQ ID NO: 420 - protein, 9 aa, Artificial Sequence
  Hemagglutinin tag
YPYDVPDYA

SEQ ID NO: 421 - protein, 11 aa, Artificial Sequence
  VSV-G Tag
YTDIEMNRLGK

SEQ ID NO: 422 - protein, 11 aa, Artificial Sequence
  HSV Tag
QPELAPEDPED

SEQ ID NO: 423 - protein, 308 aa, Homo sapiens
  Aggrecan G1 domain
TSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGE

SEQ ID NO: 424 - protein, 306 aa, Homo sapiens
  Bervican G1 domain
GALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDS

SEQ ID NO: 425 - protein, 312 aa, Homo sapiens
  Versican G1 domain
GKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPK

SEQ ID NO: 426 - protein, 307 aa, Homo sapiens
  Neurocan G1 domain
ELVALPCLFTLQPRPSAARDAPRIKWTKVRTASGQRQDLPILVAKDNVVRVAKSWQGRVSLPSYPRRRANATLLLGPLRASDSGLYRCQVVRGIEDEQDLVPLEVTGVVFHYRSARDRYALTFAEAQEACRLSSAIIAAPRHLQAAFEDGFDNCDAGWLSDRTVRYPITQSRPGCYGDRSSLPGVRSYGRRNPQELYDVYCFARELGGEVFYVGPARRLTLAGARAQCRRQGAALASVGQLHLAWHEGLDQCDPGWLADGSVRYPIQTPRRRCGGPAPGVRTVYRFANRTGFPSPAERFDAYCFRAH

The invention claimed is:

1. A TSG-6-LM multimer, comprising:
a first polypeptide containing a TSG-6 link module linked directly or indirectly via a linker to a first multimerization domain; and
a second polypeptide containing a TSG-6 link module linked directly or indirectly via a linker to a second multimerization domain, wherein:
the first and second multimerization domains interact to form a multimer containing two or more TSG-6 link modules; and
the first and second polypeptide do not comprise the full-length sequence of TSG-6.

2. The TSG-6-LM multimer of claim 1, wherein the full-length sequence of TSG-6 is set forth in SEQ ID NO:206 or SEQ ID NO:222.

3. The TSG-6-LM multimer of claim 1, wherein the link module is the only TSG-6 portion of the first polypeptide and the second polypeptide.

4. The TSG-6 multimer of claim 1, wherein the first and second link module are the same or different.

5. The TSG-6 multimer of claim 1, wherein the link module comprises the sequence of amino acids set forth in SEQ ID NO: 207, 360, 417 or 418 or a sequence of amino acids comprising at least 85% amino acid sequence identity to the sequence of amino acids set forth in SEQ ID NO: 207, 360, 417 or 418 that specifically binds HA.

6. The TSG-6 multimer of claim 1, wherein the TSG-6 link module is modified to reduce or eliminate binding to heparin.

7. The TSG-6 multimer of claim 6, wherein the TSG-6 link module comprises an amino acid replacement at an amino acid position corresponding to amino acid residue 20, 34, 41, 54, 56, 72 or 84 set forth in SEQ ID NO:360, whereby a corresponding amino acid residue is identified by alignment to a TSG-6-LM set forth in SEQ ID NO:360.

8. The TSG-6 multimer of claim 7, wherein the amino acid replacement is to a non-basic amino acid residue selected from among Asp (D), Glu (E), Ser (S), Thr (T), Asn (N), Gln (Q), Ala (A), Val (V), Ile (I), Leu (L), Met (M), Phe (F), Tyr (Y) and Trp (W).

9. The TSG-6 multimer of claim 8, wherein the TSG-6 link module comprises an amino acid replacement corresponding to amino acid replacement selected from among K20A, K34A and K41A in a TSG-6-LM set forth in SEQ ID NO:360 or the replacement at the corresponding residue in another TSG-6-LM.

10. The TSG-6 multimer of claim 9, wherein the link module comprises the sequence of amino acids set forth in SEQ ID NO:361 or 416 or a sequence of amino acids comprising at least 85% amino acid sequence identity to the sequence of amino acids set forth in SEQ ID NO: 361 or 416 that specifically binds HA.

11. The TSG-6 multimer of claim 1, wherein the multimerization domain is selected from among an immunoglobulin constant region (Fc), a leucine zipper, complementary hydrophobic regions, complementary hydrophilic regions, compatible protein-protein interaction domains, free thiols that form an intermolecular disulfide bond between two molecules, and a protuberance-into-cavity and a compensatory cavity of identical or similar size that form stable multimers.

12. The TSG-6 multimer of claim 11, wherein the multimerization domain is an Fc domain or a variant thereof that effects multimerization.

13. The TSG-6 multimer of claim 12, wherein the Fc domain is an IgG, IgM or an IgE Fc domain.

14. The TSG-6 multimer of claim 1, comprising the sequence of amino acids set forth as amino acids 24-349 of SEQ ID NO:212 or 215 or a sequence of amino acids that exhibits at least 85% amino acid sequence identity to amino acids 24-349 of SEQ ID NO:212 or 215 and specifically binds HA.

15. The TSG-6 multimer of claim 1 that has a binding affinity to HA with an association constant (Ka) of at least $1 \times 10^7 M^{-1}$.

16. The TSG-6 multimer of claim 1, wherein the first and second multimerization domain are the same or different.

17. The TSG-6 multimer of claim 1, wherein the Fc domain is an IgG, IgM or an IgE Fc domain.

18. A combination, comprising:
the TSG-6 multimer of claim 1; and
an anti-hyaluronan agent.

19. The combination of claim 18, wherein the TSG-6 multimer is conjugated to a detectable moiety that is detectably labeled or that can be detected.

20. The combination of claim 18, further comprising reagents for detection of the TSG-6 multimer.

21. The combination of claim 18, wherein the anti-hyaluronan agent is a hyaluronan degrading enzyme or is an agent that inhibits hyaluronan synthesis.

22. The combination of claim 18 that is packaged as a kit.

23. A method for selecting a subject for treatment of a hyaluronan-associated disease or condition with an anti-hyaluronan agent, comprising:
a) contacting a tissue or body fluid sample from a subject with a hyaluronan-associated disease or condition with a TSG-6-LM multimer of claim 1 or a hyaluronan binding region thereof; and
b) detecting binding of the TSG-6-LM multimer or a hyaluronan-binding region thereof to the sample, thereby determining the amount of hyaluronan (HA) in the sample, wherein if the amount of hyaluronan (HA) in the sample is at or above a predetermined threshold level, selecting the subject for treatment with an anti-hyaluronan agent.

24. The method of claim 23, wherein:
the predetermined threshold level is at least or above 0.015 μg HA/ml; or
the predetermined threshold is an HA score of at least +2 (HA$^{+2}$) or at least +3 (HA$^{+3}$); or
the predetermined threshold level is at least a percent HA positive pixels in tumor (cells and stroma) to total stain in tumor tissue of at least 10%, 10% to 25% or greater than 25%.

25. The method of claim 23, wherein the hyaluronan-associated disease or condition is a tumor or cancer.

26. The method of claim 23, wherein the TSG-6-LM in the multimer has the sequence of amino acids set forth in SEQ ID NO: 207, 360, 417 or 418, or a sequence of amino acids comprising at least 85% amino acid sequence identity to the sequence of amino acids set forth in SEQ ID NO: 207, 360, 417 or 418 and specifically binds HA.

27. The method of claim 23, wherein the TSG-6 link module in the multimer is modified to reduce or eliminate binding to heparin.

28. The method of claim 27, wherein the TSG-6 link module in the multimer comprises an amino acid replacement at an amino acid position corresponding to amino acid residue 20, 34, 41, 54, 56, 72 or 84 set forth in SEQ ID NO:360, whereby a corresponding amino acid residue is identified by alignment to a TSG-6-LM set forth in SEQ ID NO:360.

29. The method of claim 28, wherein the amino acid replacement is to a non-basic amino acid residue selected from among Asp (D), Glu (E), Ser (S), Thr (T), Asn (N), Gln (Q), Ala (A), Val (V), Ile (I), Leu (L), Met (M), Phe (F), Tyr (Y) and Trp (W).

30. The method of claim 29, wherein the TSG-6 link module in the multimer comprises an amino acid replacement corresponding to an amino acid replacement selected from among K20A, K34A and K41A in a TSG-6-LM set forth in SEQ ID NO:360 or the replacement at the corresponding residue in another TSG-6-LM.

31. The method of claim 30, wherein the TSG-6 link module in the multimer comprises a link module having the sequence of amino acids set forth in SEQ ID NO:361 or 416 or a sequence of amino acids comprising at least 85% amino acid sequence identity to the sequence of amino acids set forth in SEQ ID NO:361 or 416 that specifically binds HA.

32. The method of claim 23, wherein the TSG-6-LM multimer specifically binds to HA with a binding affinity that has a dissociation constant (Kd) of at least less than or less than $1 \times 10^{-7}$ M.

33. The method of claim 23, wherein the first and second link module in the multimer is the same or different.

34. The method of claim 23, wherein the multimerization domain in the multimer is an Fc domain or a variant thereof that effects multimerization.

35. The method of claim 23, wherein the TSG-6-LM multimer is TSG-6-LM-Fc that has the sequence of amino acids set forth as amino acids 24-349 of SEQ ID NO:212 or 215 or a sequence of amino acids that exhibits at least 85% amino acid sequence identity to amino acids 24-349 of SEQ ID NO:212 or 215 and specifically binds HA.

36. The method of claim 23, wherein the step of contacting the sample with a TSG-6-LM multimer or hyaluronan-binding region is effected at between or about between pH 5.6 to 6.4.

37. The method of claim 23, wherein the TSG-6-LM multimer is conjugated to a detectable moiety that is detectably labeled or that can be detected.

38. The method of claim 37, wherein the TSG-6-LM multimer is biotinylated.

39. The method of claim 23, wherein the sample is a stromal tissue sample from a tumor.

40. The method of claim 23, wherein the sample is taken from a biopsy from a solid tumor.

41. The method of claim 23, wherein the sample is a fluid sample that is a blood, serum, urine, sweat, semen, saliva, cerebral spinal fluid, or lymph sample.

42. The method of claim 23, wherein the sample is obtained from a mammal.

43. The method of claim 42, wherein the mammal is a human.

44. The method of claim 23, wherein hyaluronan is detected by a solid phase binding assay, histochemistry or in vivo imaging.

45. The method of claim 23, wherein the anti-hyaluronan agent is a hyaluronan degrading enzyme or is an agent that inhibits hyaluronan synthesis.

46. The method of claim 45, wherein the anti-hyaluronan agent is a hyaluronan-degrading enzyme that is modified by conjugation to a polymer.

47. The method of claim 46, wherein the polymer is PEG and the hyaluronan degrading enzyme is PEGylated.

48. The method of claim 23, wherein the anti-hyaluronan agent is a hyaluronan degrading enzyme that is a hyaluronidase.

49. The method of claim 48, wherein the hyaluronan-degrading enzyme is a PH20 hyaluronidase or truncated form thereof lacking a C-terminal glycosylphosphatidylinositol (GPI) attachment site or a portion of the GPI attachment site, whereby the truncated form exhibits hyaluronidase activity.

50. The method of 39, wherein the PH20 is selected from a human, monkey, bovine, ovine, rat, mouse or guinea pig PH20.

51. The method of claim 49, wherein the PH20 is neutral active and N-glycosylated and is selected from among:
(a) a hyaluronidase polypeptide that is a full-length PH20 or is a C-terminal truncated form of the PH20, wherein the truncated form includes at least amino acid residues 36-464 of SEQ ID NO:1, wherein the full-length PH20 comprises the sequence of amino acids set forth in SEQ ID NO:2; or
(b) a hyaluronidase polypeptide comprising a sequence of amino acids having at least 85%, 86%, 87%, 88%, 89%, 90%, 91%, 92%, 93%, 94%, 95%, 96%, 97%, 98%, 99% or more sequence identity with the polypeptide or truncated form of sequence of amino acids set forth in SEQ ID NO:2; or
(c) a hyaluronidase polypeptide of (a) or (b) comprising amino acid substitutions, whereby the hyaluronidase polypeptide has a sequence of amino acids having at least 85%, 86%, 87%, 88%, 89%, 90%, 91%, 92%, 93%, 94%, 95%, 96%, 97%, 98%, 99% or more sequence identity with the polypeptide set forth in SEQ ID NO:2 or the with the corresponding truncated forms thereof.

52. The method of claim 49, wherein the PH20 or truncated form thereof comprises the sequence of amino acids set forth in any of SEQ ID NOS: 4-9, 47, 48, 150-170 and 183-189 or a sequence of amino acids that exhibits at least 85% sequence identity to any of SEQ ID NOS: 4-9, 47, 48, 150-170 and 183-189.

53. The method of claim 23, comprising administering a corticosteroid prior to administration of the anti-hyaluronan agent, with administration of the anti-hyaluronan agent or after administration of the anti-hyaluronan agent, wherein the corticosteroid is administered in an amount sufficient to ameliorate an adverse effect in the subject from the administered anti-hyaluronan agent.

54. The method of claim 53, wherein the corticosteroid is a glucocorticoid.

55. The method of claim 23, further comprising:
c) administering an anti-hyaluronan agent to the selected subject, thereby treating the selected subject with an anti-hyaluronan agent.

56. A method of diagnosis of a hyaluronan-associated disease or condition, comprising:
contacting a tissue or body fluid sample from a subject with a hyaluronan-associated disease or condition with a TSG-6-LM multimer of claim 1 or a hyaluronan binding region thereof; and
detecting binding of the TSG-6-LM multimer or a hyaluronan-binding region thereof that binds to the sample, thereby determining the amount of hyaluronan in the sample, wherein the subject is diagnosed with a hyaluronan-associated disease or condition if the amount of hyaluronan is above a predetermined level or above the hyaluronan level of a reference sample.

57. A method for treating a subject with a tumor, comprising:
a) administering an anti-hyaluronan agent to a subject;
b) contacting a tissue or body fluid sample from the subject treated with the anti-hyaluronan agent with a TSG-6-LM multimer of claim 1;
c) detecting binding of the TSG-6-LM multimer to the sample, thereby determining the amount of hyaluronan in the sample;
d) comparing the level of hyaluronan to a control or reference sample to thereby determine the amount of hyaluronan in the sample relative to the control or reference sample, wherein detection of a decrease in hyaluronan compared to the control or reference sample indicates that the treatment is effective; and
e) altering treatment based on the determined amount of hyaluronan in the sample relative to the control or reference sample, wherein:
if the amount of hyaluronan in the sample is at or above the amount in the control or reference sample, continuing treatment or escalating treatment by increasing the dosage and/or dose schedule of the anti-hyaluronan agent; or
if the amount of hyaluronan in the sample is below the amount in the control or reference sample, continuing the treatment, reducing treatment by decreasing the dosage and/or dose schedule or terminating treatment of the anti-hyaluronan agent.

58. The method of claim 57, wherein the control or reference sample is a corresponding sample from the subject before treatment with the anti-hyaluronan agent or is a corresponding sample from the subject after the previous dose of the anti-hyaluronan agent.

* * * * *

UNITED STATES PATENT AND TRADEMARK OFFICE
CERTIFICATE OF CORRECTION

PATENT NO.       : 8,846,034 B2  
APPLICATION NO.  : 13/694071  
DATED            : September 30, 2014  
INVENTOR(S)      : Jiang et al.

It is certified that error appears in the above-identified patent and that said Letters Patent is hereby corrected as shown below:

IN THE CLAIMS:

In Column 180, line 31 to line 33 should read:

50. The method of claim 49, wherein the PH20 is selected from a human, monkey, bovine, ovine, rat, mouse or guinea pig PH20.

Signed and Sealed this  
Thirtieth Day of December, 2014

Michelle K. Lee  
*Deputy Director of the United States Patent and Trademark Office*